United States Patent
Wuestefeld et al.

(10) Patent No.: US 12,421,515 B2
(45) Date of Patent: Sep. 23, 2025

(54) METHOD OF STIMULATING PROLIFERATION OF A CELL

(71) Applicant: Agency for Science, Technology and Research, Singapore (SG)

(72) Inventors: Torsten Wuestefeld, Singapore (SG); Viktoriia Iakovleva, Singapore (SG)

(73) Assignee: Agency for Science, Technology and Research, Singapore (SG)

( * ) Notice: Subject to any disclaimer, the term of this patent is extended or adjusted under 35 U.S.C. 154(b) by 278 days.

(21) Appl. No.: 17/731,259

(22) Filed: Apr. 27, 2022

(65) Prior Publication Data

US 2022/0364089 A1 Nov. 17, 2022

Related U.S. Application Data

(63) Continuation of application No. PCT/SG2021/050443, filed on Jul. 30, 2021.

(51) Int. Cl.
*C12N 15/113* (2010.01)
*A61P 1/16* (2006.01)

(52) U.S. Cl.
CPC .............. *C12N 15/113* (2013.01); *A61P 1/16* (2018.01); *C12N 2310/14* (2013.01); *C12N 2310/351* (2013.01); *C12N 2310/531* (2013.01); *C12N 2320/30* (2013.01)

(58) Field of Classification Search
CPC .............. C12N 15/113; C12N 2310/14; C12N 2310/351; C12N 2310/11; A61P 1/16; A61K 31/7125; A61K 31/713; A61K 31/712
USPC ...................... 435/6.1, 91.1, 91.31, 455, 458; 514/44 A; 536/23.1, 24.5
See application file for complete search history.

(56) References Cited

U.S. PATENT DOCUMENTS

| | | | | |
|---|---|---|---|---|
| 5,932,442 | A | * 8/1999 | Lal | C12N 9/93 435/320.1 |
| 2008/0113351 | A1 | * 5/2008 | Naito | A61P 5/26 536/23.1 |
| 2019/0255143 | A1 | 8/2019 | Tabas | |
| 2019/0300872 | A1 | * 10/2019 | Woolf | C12N 15/09 |

FOREIGN PATENT DOCUMENTS

| | | | |
|---|---|---|---|
| CN | 111154760 A | 5/2020 | |
| EP | 1074617 A2 * | 2/2001 | ............. C07K 14/47 |
| WO | 2019/149738 A1 | 8/2019 | |

OTHER PUBLICATIONS

Roberts et al (Nature Rev., Drug Discovery, vol. 19, pp. 673-694 (2020)) (Year: 2020).*
Osborn et al (Nucleic Acid Therapeutics, vol. 28, No. 3, pp. 128-136 (2018)) (Year: 2018).*
Damase et al (Frontiers in Bioengineering and Biotechnology, vol. 9, Article 628137, pp. 1-24 (2021)) (Year: 2021).*
Bost et al (ACS Nano, vol. 15, pp. 13993-14021 (2021)) (Year: 2021).*
Fan W. et al., RUVBL 1-ITFG1 interaction is required for collective invasion in breast cancer. Biochim Biophys Acta Gen Subj, Mar. 21, 2017, vol. 1861, No. 7, pp. 1788-1800.
Fiscella M. et al., TIP, a T-cell factor identified using high-throughput screening increases survival in a graft-versus-host disease model. Nat Biotechnol, Feb. 24, 2003, vol. 21, No. 3, pp. 302-307.
Vollmann E.H. et al., Identification of Novel Fibrosis Modifiers by In Vivo siRNA Silencing. Mol Ther Nucleic Acids, Apr. 20, 2017, vol. 7, pp. 314-323.
Zhao Z. et al., siRNA- and mi RNA-based therapeutics for liver fibrosis. Transl Res, Aug. 13, 2019, vol. 214, pp. 17-29.
Iakovleva V. et al., OS-1290 Integrin Alpha FG-GAP Repeat Containing 1 (ITFG1) knockdown enhances liver regeneration and attenuates chronic liver damage related liver fibrosis. J Hepatol, Jun. 26, 2021, vol. 75, Suppl 2, p. S233.
PCT/SG2021/050443; International Search Report and Written Opinion; dated Nov. 1, 2021; 17 pages.
U.S. Appl. No. 17/823,839, "Non-Final Office Action", Jan. 23, 2024, 15 pages.
Bost, et al., "Delivery of Oligonucleotide Therapeutics: Chemical Modifications, Lipid Nanoparticles, and Extracellular Vesicles", ACS Nano, vol. 15, No. 9, 2021, pp. 13993-14021.
Damase, et al., "The Limitless Future of RNA Therapeutics", Frontiers in Bioengineering and Biotechnology, vol. 9, Article 628137, Mar. 18, 2021, pp. 1-24.
Osborn, et al., "Improving siRNA Delivery In Vivo Through Lipid Conjugation", Nucleic Acid Therapeutics, vol. 28, No. 3, 2018, pp. 128-136.
Roberts, et al., "Advances in Oligonucleotide Drug Delivery", Nature Reviews Drug Discovery, vol. 19, Oct. 2020, pp. 673-694.
International Search Report received in Chinese Patent Application No. 2021800586834, dated Dec. 30, 2024.

\* cited by examiner

*Primary Examiner* — Jane J Zara
(74) *Attorney, Agent, or Firm* — Kilpatrick Townsend & Stockton LLP

(57) ABSTRACT

Methods of treating and preventing diseases associated with fibrosis are disclosed, as well as agents for use in such methods. The methods comprise inhibiting at least one of ITFG1, MFAP4, GRHPR, ABCC4, PAK3, TRNP1, APLN, KIF20A, and/or LTB. In one embodiment, the disease is a liver disease or condition. Also disclosed are methods of promoting regeneration of cells, such as hepatocytes.

16 Claims, 89 Drawing Sheets
Specification includes a Sequence Listing.

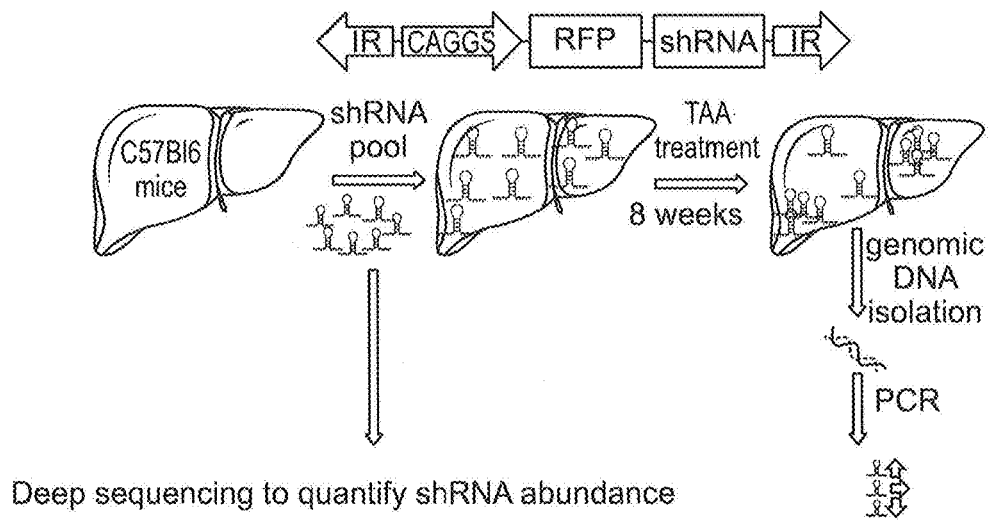
FIG. 1A
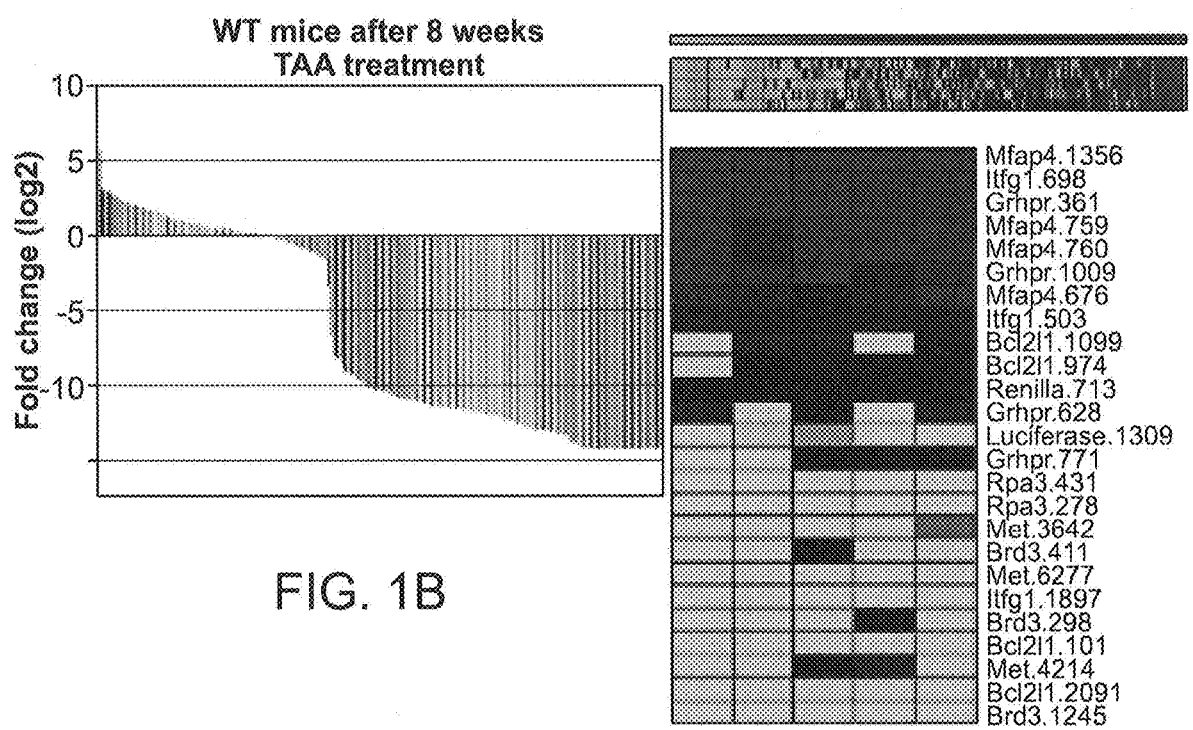
FIG. 1B
FIG. 1C

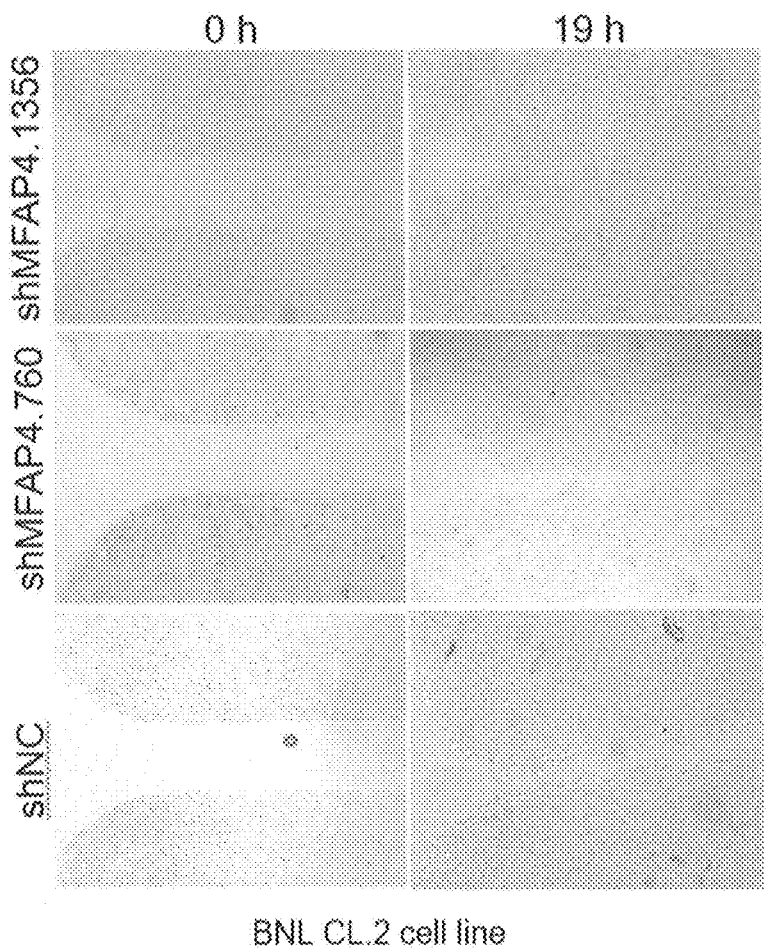
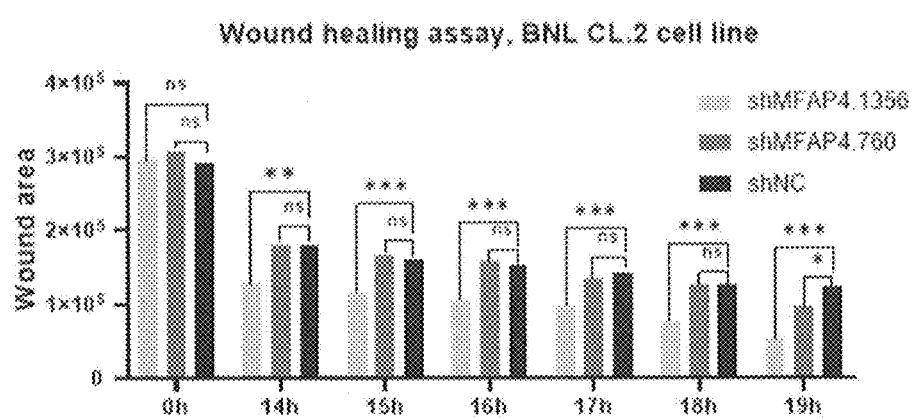
FIG. 2C

FIG. 2E

| shRNA | Doubling time (h) |
|---|---|
| shMfap4.1356 | 35.7 |
| shNC | 45.5 |
| Published data | 45.6 |

FIG. 2F

| shRNA | G0/G1 phase | S phase | G2 phase |
|---|---|---|---|
| shMFAP4.1356 | 39.3 | 15.0 | 45.6 |
| shMFAP4.760 | 51.8 | 10.2 | 37.9 |
| shNC | 56.6 | 10.7 | 32.6 |

FIG. 2G
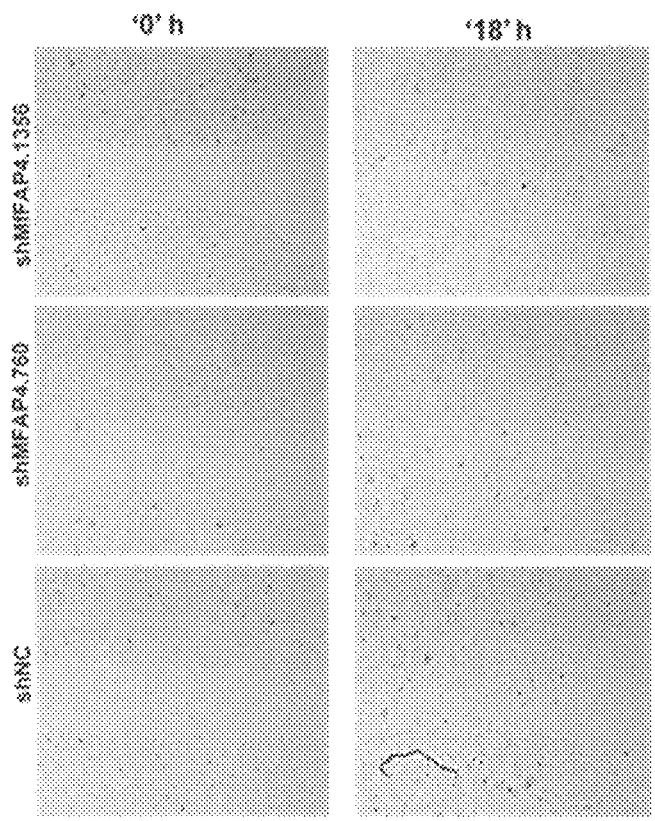
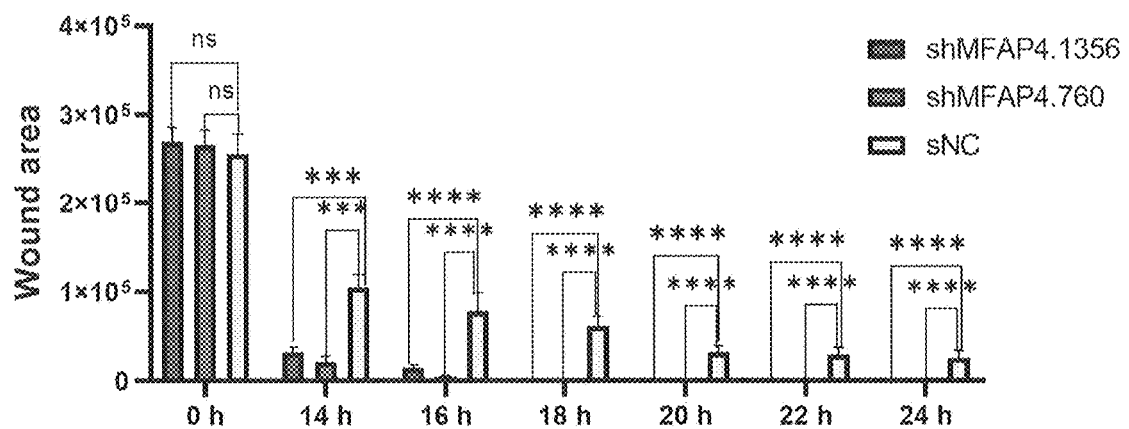

*Dilution of constructs 1.25 ug plasmid: 0.25 ug SB13*

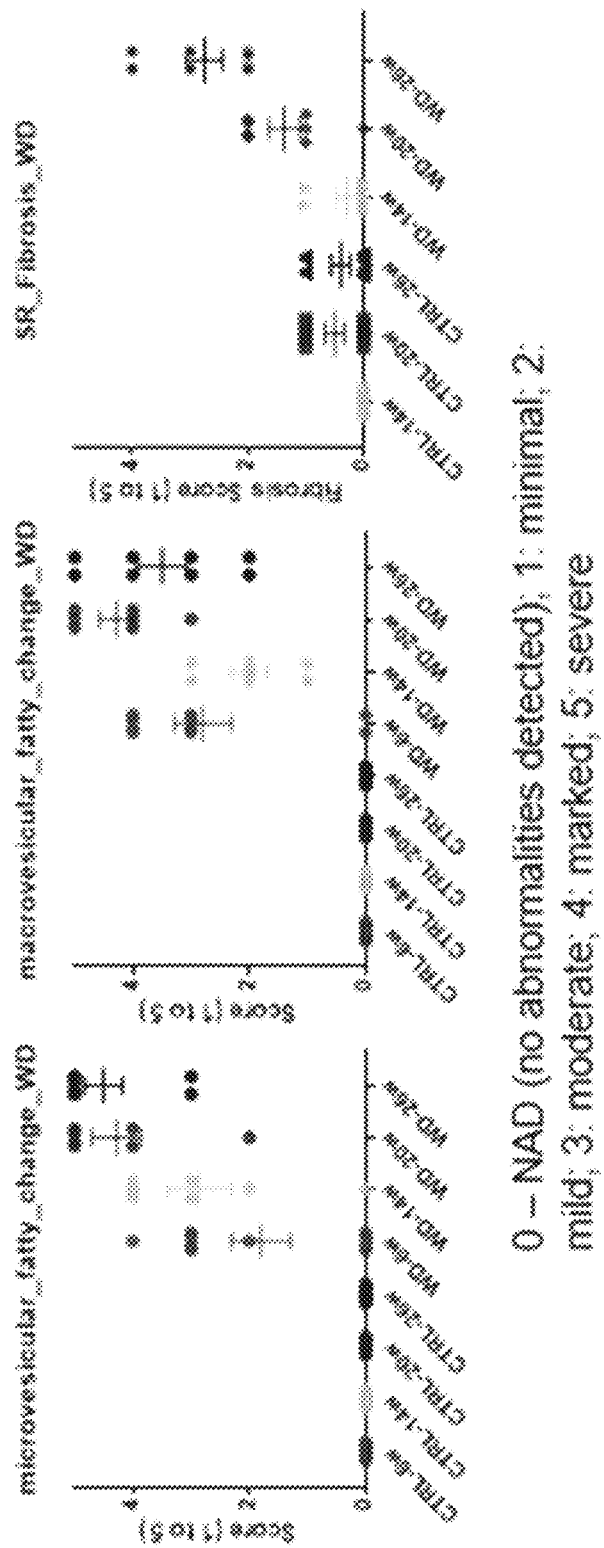

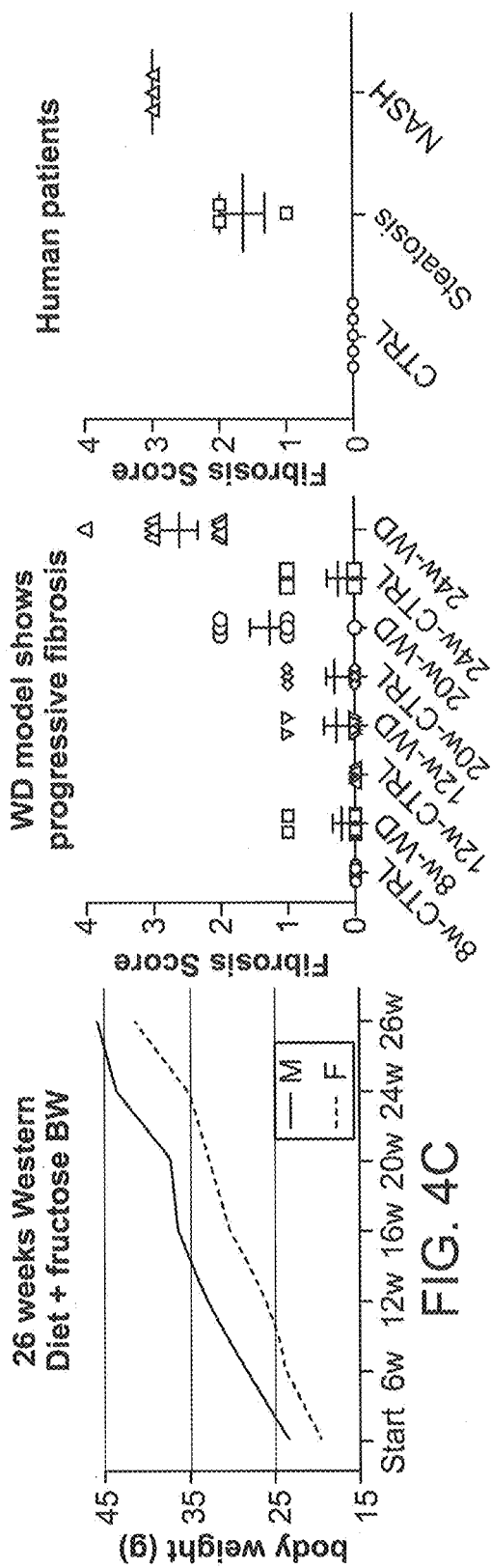
FIG. 4C
FIG. 4D
FIG. 4E
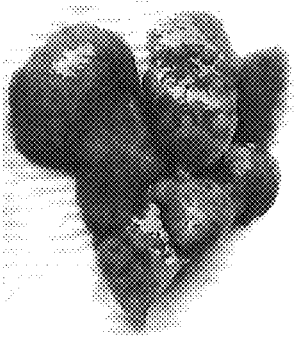
FIG. 4F
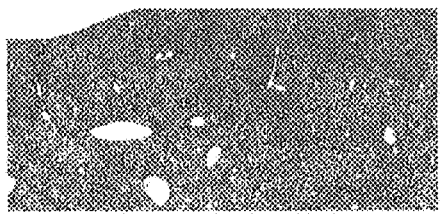
FIG. 4G
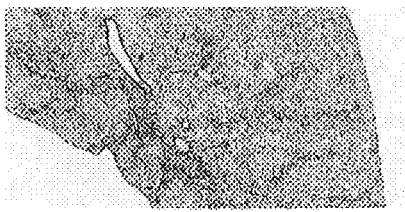
FIG. 4H FIG. 8A
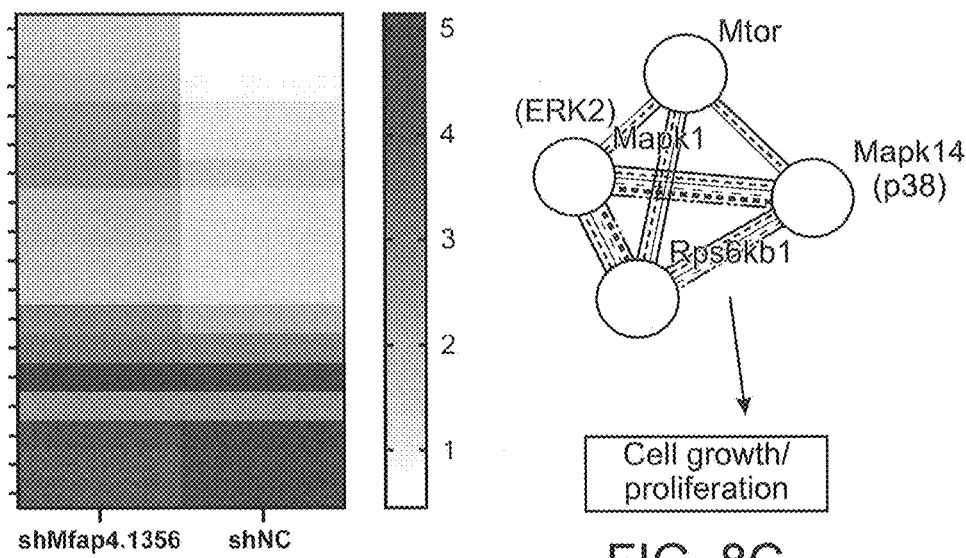
FIG. 8B
FIG. 8C
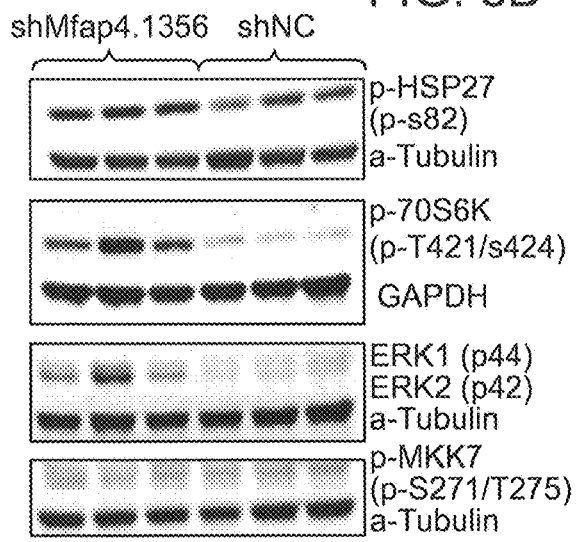
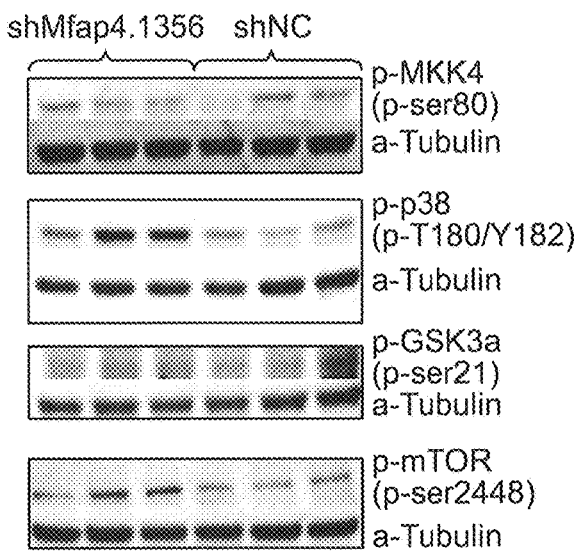
FIG. 8D

- Specific Mfap4 staining in human liver.
- Staining is stronger in cirrhotic liver.
- Interestingly we see also nuclear staining.

GFP imaging

Immortalized human hepatocytes SV40

FIG. 11A
FIG. 11B
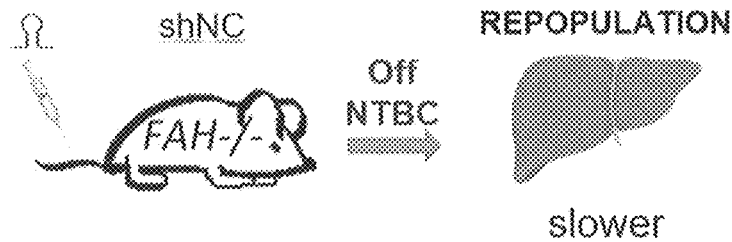
FIG. 11C
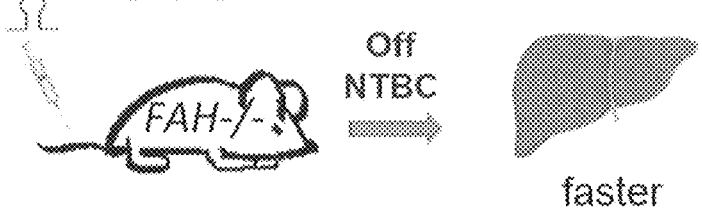
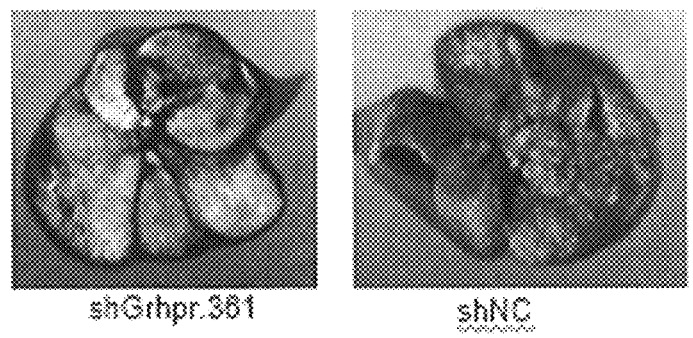
FIG. 11D
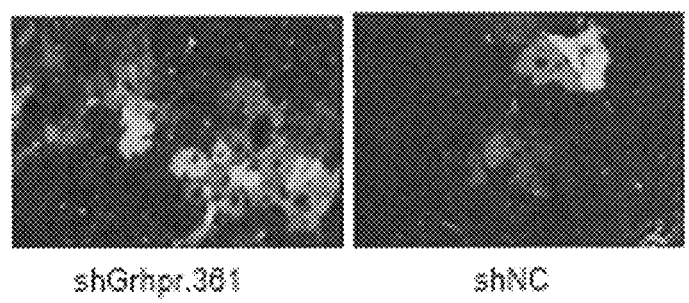

FIG. 11E
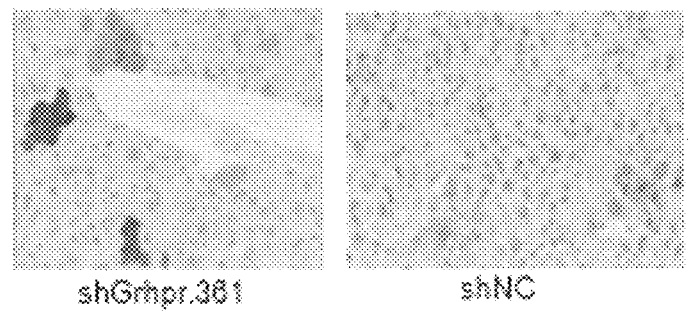
FIG. 11F
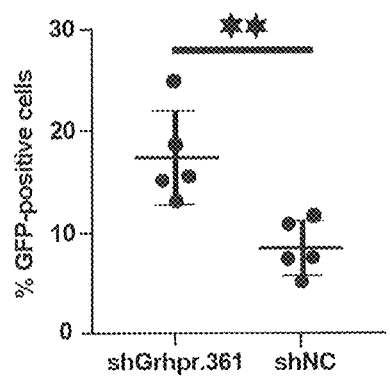
FIG. 11G  Survival curve at dilution of constructs 1:30
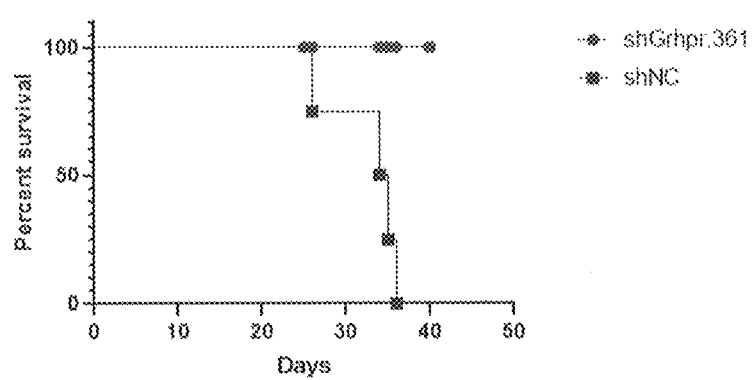

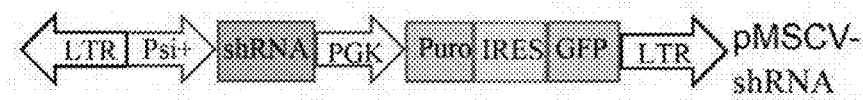
FIG.16A
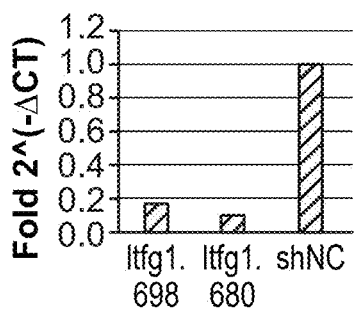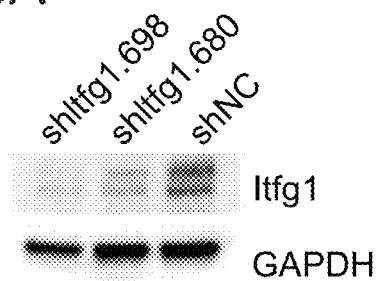
FIG.16B
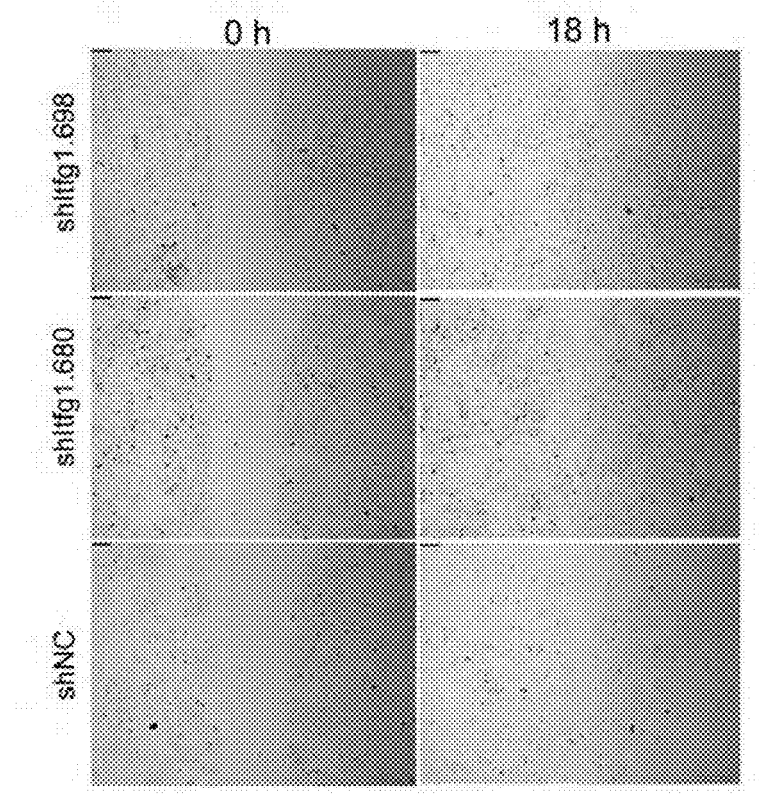
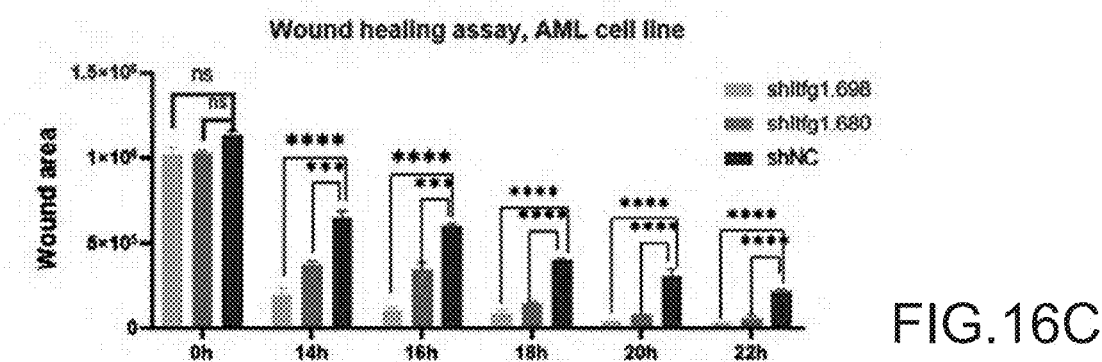
FIG.16C

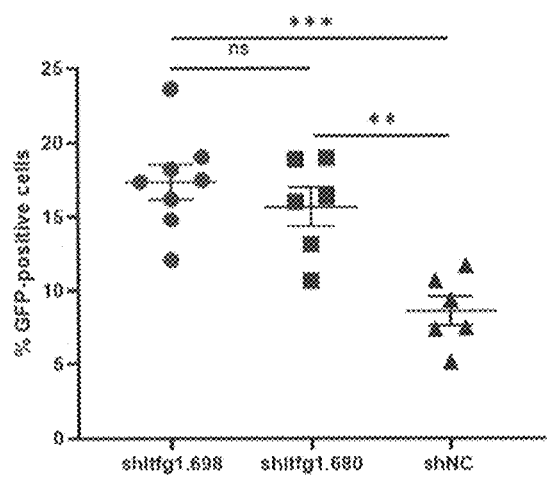
FIG. 16G FAH-/- repopulation, 18 days, 1:20 dilution
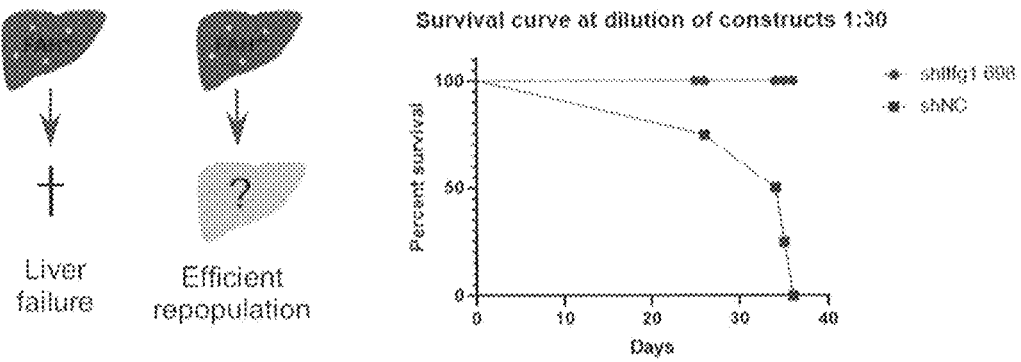
FIG. 16H shltfg.698    shNC

*GFP imager*

Fah-/- repopulated mouse liver 6 month after Western Diet

ITFG1 - ENSG00000129636 - DESeq2 Results

| Analysis | Condition | Reference | Type | log2FC | Padj |
|---|---|---|---|---|---|
| diseaseStage | Simple_Steatosis_NAFLD | Healthy | upReg | 0.14418 | 0.36633 |
| diseaseStage | Incomplete_NAFLD | Healthy | upReg | 0.02061 | 0.93103 |
| diseaseStage | NASH_Early_Fibrosis | Healthy | upReg | 0.0405 | 0.80014 |
| diseaseStage | NASH_Advanced_Fibrosis | Healthy | downReg | -0.04966 | 0.74318 |
| diseaseStage | Cirrhosis | Healthy | upReg | 0.00485 | 0.98494 |
| steatosisGroup | Steatosis1 | Steatosis0 | upReg | 0.05017 | 0.69477 |
| steatosisGroup | Steatosis2 | Steatosis0 | upReg | 0.16766 | 0.25128 |
| steatosisGroup | Steatosis3 | Steatosis0 | upReg | 0.09268 | 0.58054 |
| ballooningGroup | Ballooning1 | Ballooning0 | upReg | 0.10344 | 0.42485 |
| ballooningGroup | Ballooning2 | Ballooning0 | downReg | -0.04851 | 0.70435 |
| inflammationGroup | inflammation1 | inflammation0 | upReg | -0.06393 | 0.58538 |
| inflammationGroup | inflammation2 | inflammation0 | downReg | -0.05675 | 0.76298 |
| inflammationGroup | inflammation3 | inflammation0 | downReg | -0.26781 | 0.1435 |
| fibrosisGroup | Fibrosis1 | Fibrosis0 | downReg | -0.10001 | 0.44571 |
| fibrosisGroup | Fibrosis2 | Fibrosis0 | downReg | -0.11816 | 0.44046 |
| fibrosisGroup | Fibrosis3 | Fibrosis0 | downReg | -0.1251 | 0.40393 |
| fibrosisGroup | Fibrosis4 | Fibrosis0 | downReg | -0.11509 | 0.34234 |

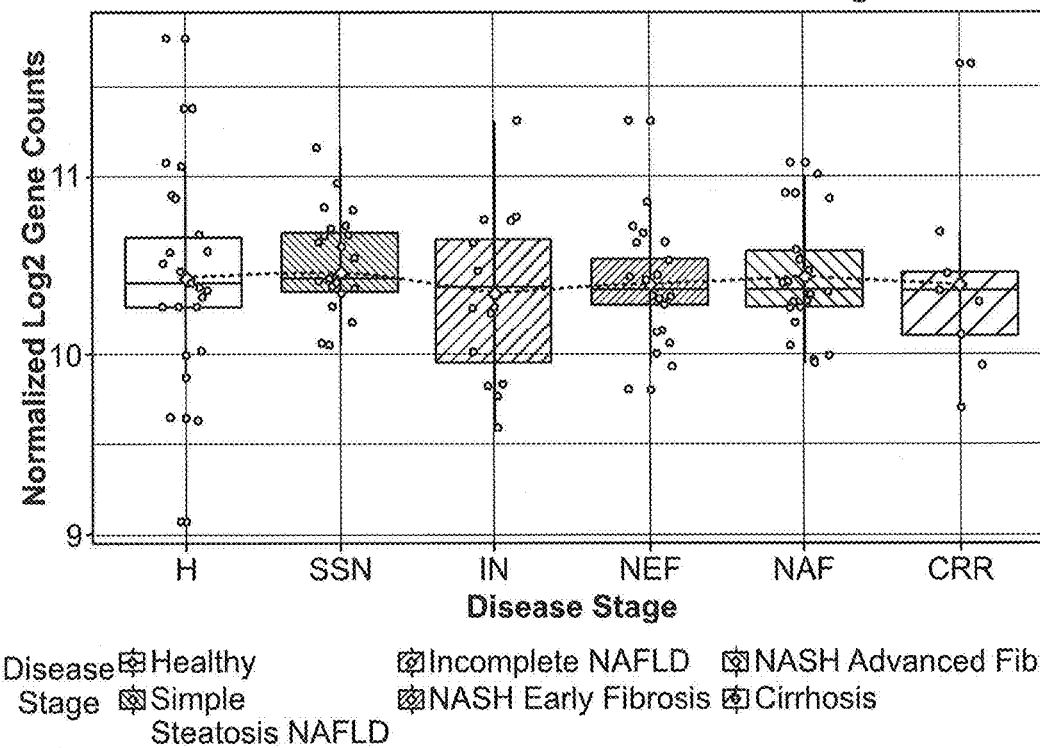

FIG. 18B pMSCV-shRNA

HepG2 cell line

Further validation
ABCC4
Pak3
Apln
Kif20a
TRNP1
LTB

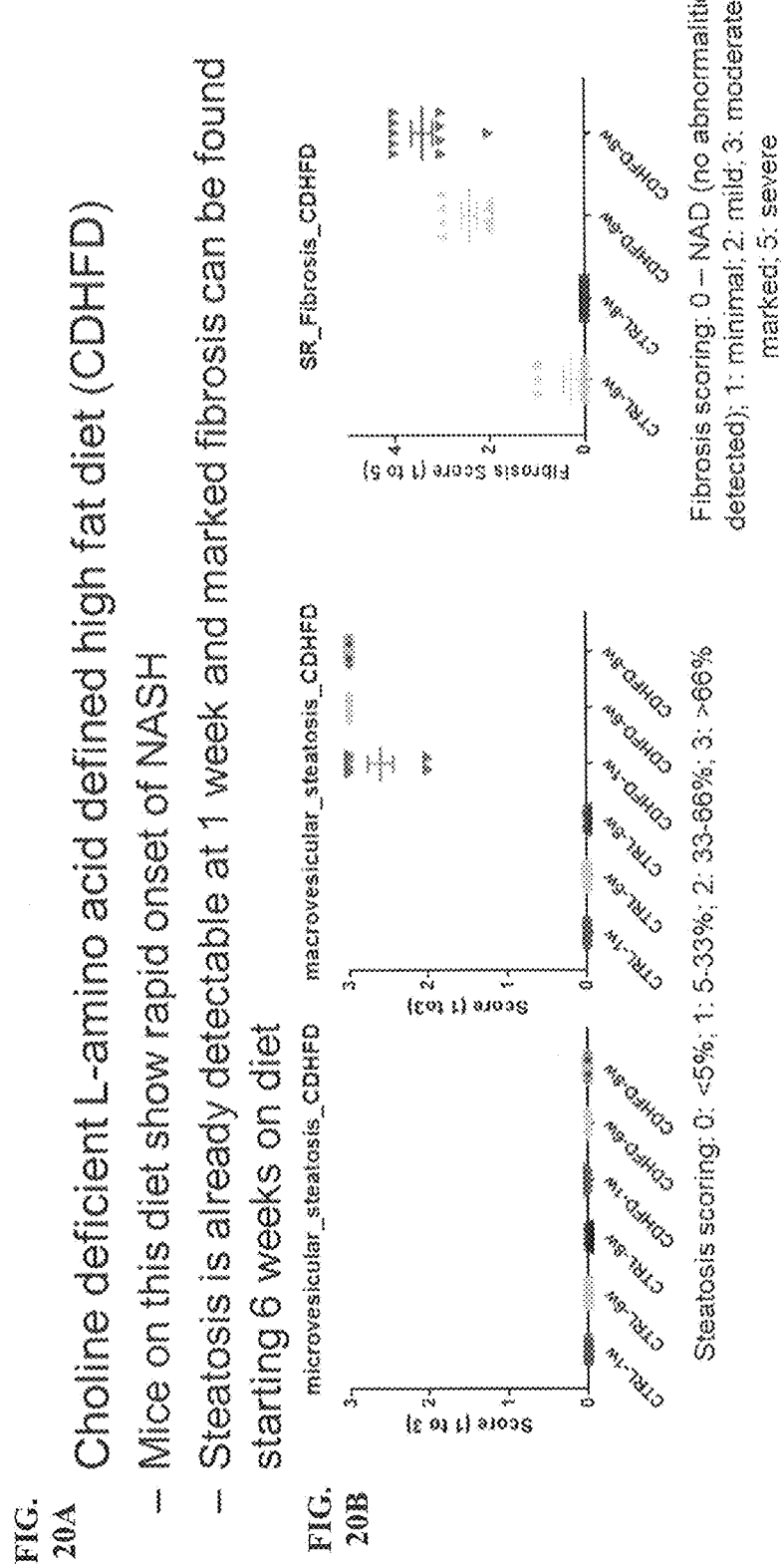

PAK3 - ENSG00000077264 - DESeq2 Results

| Analysis | Condition | Reference | Type | log2FC | Padj |
|---|---|---|---|---|---|
| diseaseStage | Simple_Steatosis_NAFLD | Healthy | downReg | -0.16368 | 0.84552 |
| diseaseStage | Incomplete_NAFLD | Healthy | downReg | -0.12792 | 0.88807 |
| diseaseStage | NASH_Early_Fibrosis | Healthy | downReg | 0.14496 | 0.82063 |
| diseaseStage | NASH_Advanced_Fibrosis | Healthy | upReg | 0.85831 | 0.05391 |
| diseaseStage | Cirrhosis | Healthy | upReg | 1.46315 | 0.01412 |
| steatosisGroup | Steatosis1 | Steatosis0 | downReg | -0.43411 | 0.33816 |
| steatosisGroup | Steatosis2 | Steatosis0 | downReg | -0.23978 | 0.76018 |
| steatosisGroup | Steatosis3 | Steatosis0 | downReg | -0.22464 | 0.76815 |
| ballooningGroup | Ballooning1 | Ballooning0 | downReg | -0.03067 | 0.97259 |
| ballooningGroup | Ballooning2 | Ballooning0 | upReg | 0.46121 | 0.29955 |
| inflammationGroup | inflammation1 | inflammation0 | upReg | 0.33696 | 0.47722 |
| inflammationGroup | inflammation2 | inflammation0 | downReg | -0.07474 | 0.93477 |
| inflammationGroup | inflammation3 | inflammation0 | upReg | 0.21098 | 0.85307 |
| fibrosisGroup | Fibrosis1 | Fibrosis0 | upReg | 0.03773 | 0.95866 |
| fibrosisGroup | Fibrosis2 | Fibrosis0 | upReg | 0.39784 | 0.51875 |
| fibrosisGroup | Fibrosis3 | Fibrosis0 | upReg | 0.46919 | 0.43218 |
| fibrosisGroup | Fibrosis4 | Fibrosis0 | upReg | 1.29834 | 0.00075 |

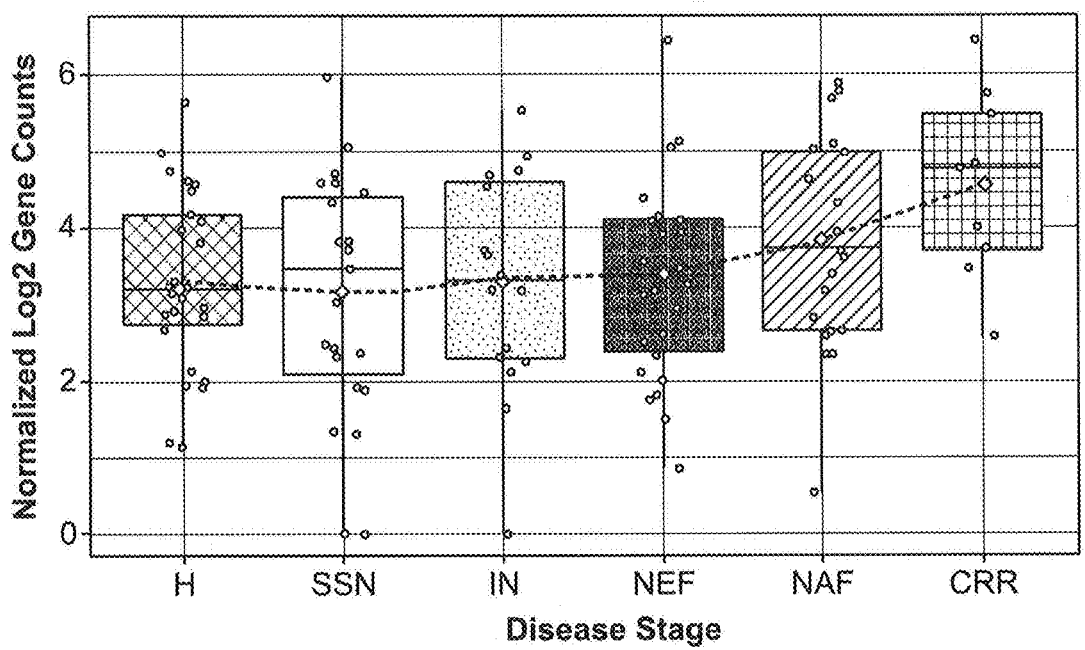

FIG. 22C

TRNP1 - ENSG00000253368 - DESeq2 Results

| Analysis | Condition | Reference | Type | log2FC | Padj |
|---|---|---|---|---|---|
| diseaseStage | Simple_Steatosis_NAFLD | Healthy | downReg | -0.16368 | 0.84552 |
| diseaseStage | Incomplete_NAFLD | Healthy | downReg | -0.12792 | 0.88807 |
| diseaseStage | NASH_Early_Fibrosis | Healthy | downReg | 0.14496 | 0.82063 |
| diseaseStage | NASH_Advanced_Fibrosis | Healthy | downReg | 0.85831 | 0.05391 |
| diseaseStage | Cirrhosis | Healthy | upReg | 1.46315 | 0.01412 |
| steatosisGroup | Steatosis1 | Steatosis0 | downReg | -0.43411 | 0.33816 |
| steatosisGroup | Steatosis2 | Steatosis0 | downReg | -0.23978 | 0.76018 |
| steatosisGroup | Steatosis3 | Steatosis0 | downReg | -0.22464 | 0.76815 |
| ballooningGroup | Ballooning1 | Ballooning0 | downReg | -0.03067 | 0.97259 |
| ballooningGroup | Ballooning2 | Ballooning0 | downReg | 0.46121 | 0.29955 |
| inflammationGroup | inflammation1 | inflammation0 | downReg | 0.33696 | 0.47722 |
| inflammationGroup | inflammation2 | inflammation0 | downReg | -0.07474 | 0.93477 |
| inflammationGroup | inflammation3 | inflammation0 | downReg | 0.21098 | 0.85307 |
| fibrosisGroup | Fibrosis1 | Fibrosis0 | downReg | 0.03773 | 0.95866 |
| fibrosisGroup | Fibrosis2 | Fibrosis0 | downReg | 0.39784 | 0.51875 |
| fibrosisGroup | Fibrosis3 | Fibrosis0 | downReg | 0.46919 | 0.43218 |
| fibrosisGroup | Fibrosis4 | Fibrosis0 | upReg | 1.29834 | 0.00075 |

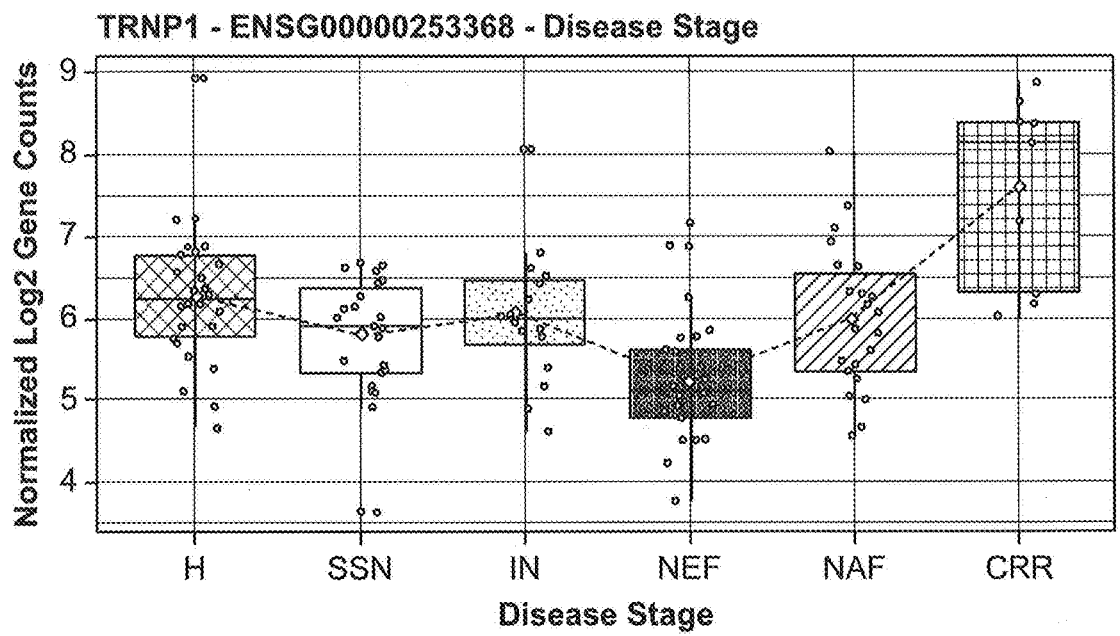

FIG. 23C

APLN - ENSG00000171388 - DESeq2 Results

| Analysis | Condition | Reference | Type | log2FC | Padj |
|---|---|---|---|---|---|
| diseaseStage | Simple_Steatosis_NAFLD | Healthy | downReg | -0.42061 | 0.51014 |
| diseaseStage | Incomplete_NAFLD | Healthy | upReg | 0.10152 | 0.90618 |
| diseaseStage | NASH_Early_Fibrosis | Healthy | downReg | -0.19591 | 0.73029 |
| diseaseStage | NASH_Advanced_Fibrosis | Healthy | downReg | -0.12857 | 0.82464 |
| diseaseStage | Cirrhosis | Healthy | upReg | 2.30945 | 6.398e-06 |
| steatosisGroup | Steatosis1 | Steatosis0 | downReg | -0.61394 | 0.14837 |
| steatosisGroup | Steatosis2 | Steatosis0 | downReg | -0.34948 | 0.63534 |
| steatosisGroup | Steatosis3 | Steatosis0 | downReg | -0.65674 | 0.29672 |
| ballooningGroup | Ballooning1 | Ballooning0 | upReg | 0.251 | 0.7052 |
| ballooningGroup | Ballooning2 | Ballooning0 | upReg | 0.03859 | 0.95326 |
| inflammationGroup | inflammation1 | inflammation0 | downReg | -0.50195 | 0.24597 |
| inflammationGroup | inflammation2 | inflammation0 | downReg | -1.32571 | 0.01819 |
| inflammationGroup | inflammation3 | inflammation0 | downReg | -1.2991 | 0.08982 |
| fibrosisGroup | Fibrosis1 | Fibrosis0 | downReg | -0.17699 | 0.76801 |
| fibrosisGroup | Fibrosis2 | Fibrosis0 | upReg | 0.31572 | 0.61136 |
| fibrosisGroup | Fibrosis3 | Fibrosis0 | downReg | -0.28593 | 0.6619 |
| fibrosisGroup | Fibrosis4 | Fibrosis0 | upReg | 1.63457 | 6.599e-06 |

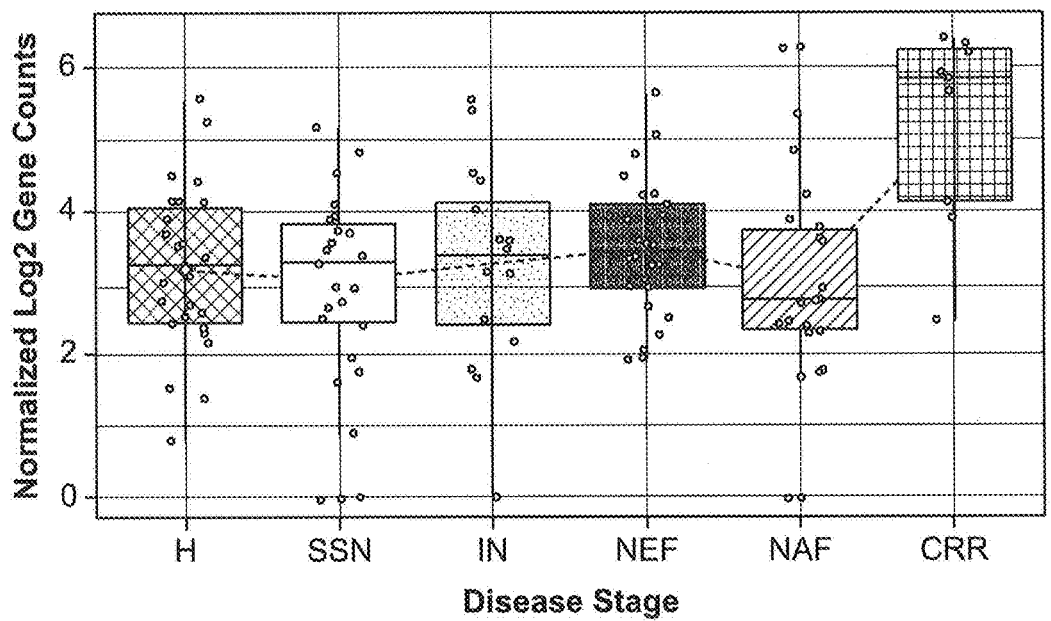

FIG. 24C

LTB - ENSG00000227507 - DESeq2 Results

| Analysis | Condition | Reference | Type | log2FC | Padj |
|---|---|---|---|---|---|
| diseaseStage | Simple_Steatosis_NAFLD | Healthy | upReg | 0.77672 | 0.05295 |
| diseaseStage | Incomplete_NAFLD | Healthy | upReg | 0.96838 | 0.01388 |
| diseaseStage | NASH_Early_Fibrosis | Healthy | upReg | 1.10855 | 0.00034 |
| diseaseStage | NASH_Advanced_Fibrosis | Healthy | upReg | 1.5525 | 1.236e-07 |
| diseaseStage | Cirrhosis | Healthy | upReg | 1.23855 | 0.00428 |
| steatosisGroup | Steatosis1 | Steatosis0 | upReg | 0.76774 | 0.00467 |
| steatosisGroup | Steatosis2 | Steatosis0 | upReg | 0.76214 | 0.05904 |
| steatosisGroup | Steatosis3 | Steatosis0 | upReg | 1.17745 | 0.00129 |
| ballooningGroup | Ballooning1 | Ballooning0 | upReg | 0.47569 | 0.16194 |
| ballooningGroup | Ballooning2 | Ballooning0 | upReg | 0.9027 | 0.00063 |
| inflammationGroup | inflammation1 | inflammation0 | upReg | 0.48322 | 0.10561 |
| inflammationGroup | inflammation2 | inflammation0 | upReg | 0.44956 | 0.32318 |
| inflammationGroup | inflammation3 | inflammation0 | upReg | 1.26002 | 0.00969 |
| fibrosisGroup | Fibrosis1 | Fibrosis0 | upReg | 0.46428 | 0.19242 |
| fibrosisGroup | Fibrosis2 | Fibrosis0 | upReg | 0.63739 | 0.11172 |
| fibrosisGroup | Fibrosis3 | Fibrosis0 | upReg | 1.13633 | 0.00115 |
| fibrosisGroup | Fibrosis4 | Fibrosis0 | upReg | 0.89188 | 0.00264 |

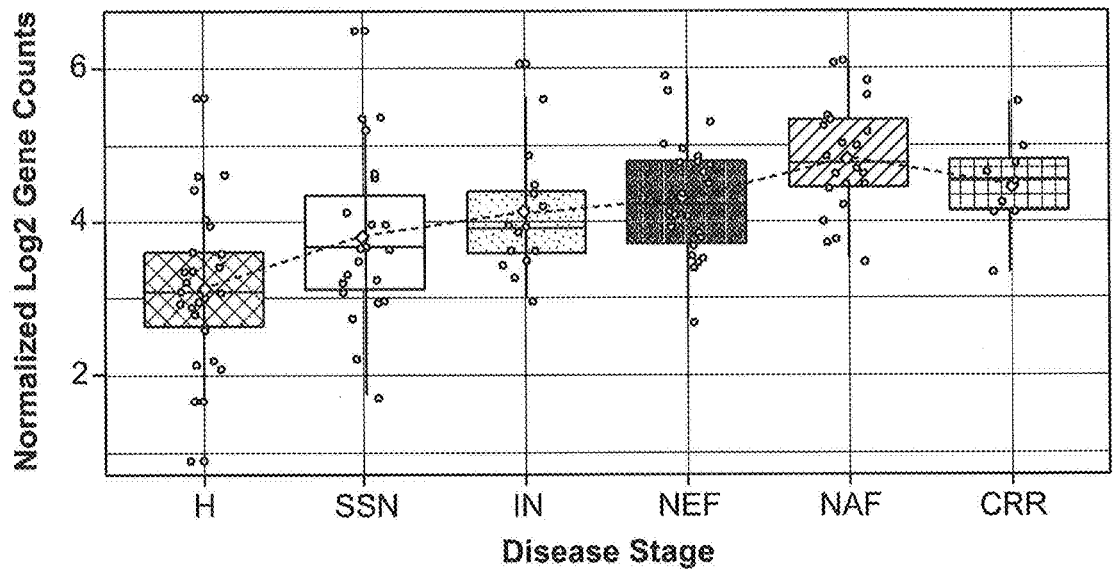

FIG. 26C

Bright field

GFP imager

6 µM each

11 µM each

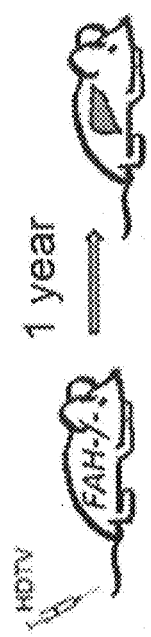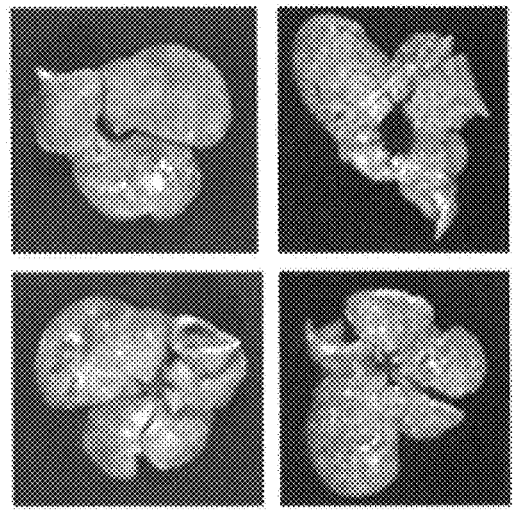
FIG. 30A
FIG. 30B Bright field
FIG. 30C GFP imager pMSCV-shRNA HepG2 cell line

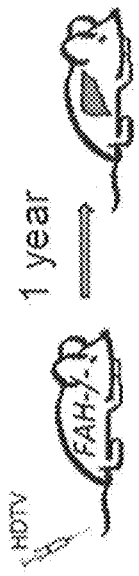
FIG. 34A
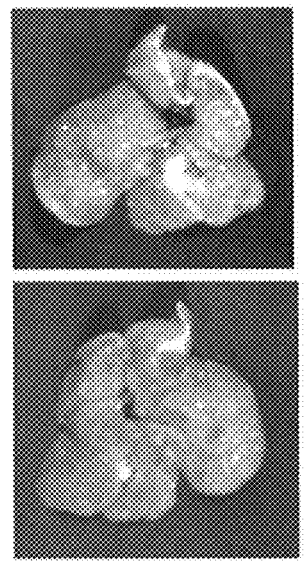
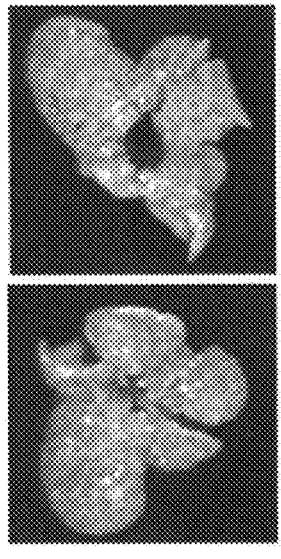
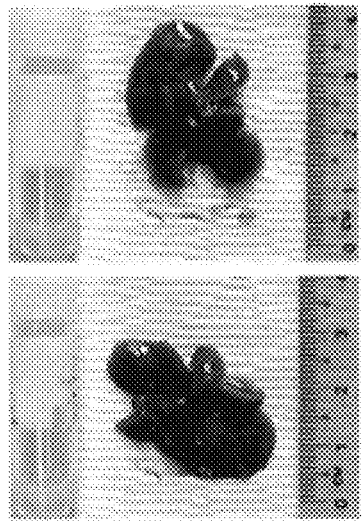
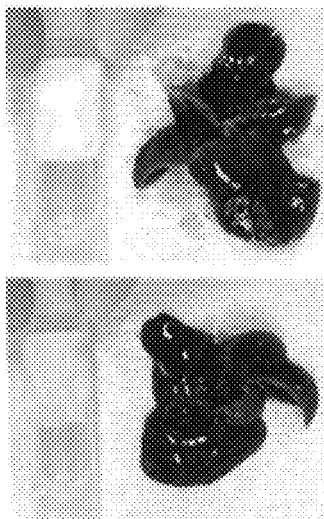
FIG. 34B
FIG. 34C Bright field x50 magnification Based on AMPL Pathology Evaluation (A*STAR)

Based on HistoIndex Pathology Evaluation

Mfap4 or Itfg1 knockdown enhances proliferation and regeneration beyond liver

METHOD OF STIMULATING PROLIFERATION OF A CELL

This application is a continuation of International Application No. PCT/SG2021/050443, filed on 30 Jul. 2021, which claims priority from SG 10202007297P filed 30 Jul. 2020, the contents and elements of which are herein incorporated by reference for all purposes.

REFERENCE TO A "SEQUENCE LISTING" SUBMITTED AS ASCII TEXT FILES VIA EFS-WEB

The Sequence Listing written in file 109046-1326735-SeqListing.txt created on Apr. 27, 2022, 1,592,517 bytes, machine format IBM-PC, MS-Windows operating system, in accordance with 37 C.F.R. §§ 1.821 to 1.825, is hereby incorporated by reference in its entirety for all purposes.

FIELD OF THE INVENTION

The present disclosure relates generally to the field of regenerative therapy. In particular, the specification teaches a method of stimulating or increasing proliferation and/or regeneration of a cell in a subject, comprising administering to the subject an inhibitor of a gene or corresponding gene product associated with organ regeneration to stimulate or increase proliferation of the cell in the subject.

BACKGROUND

The rising incidence of acute and chronic liver failure, which causes more than 1.3 million deaths per year worldwide (World Health Organization, 2018), represents a major global health concern. The main underlying causes of end-stage liver disease are hepatitis virus infections (especially hepatitis B and C), drug- and alcohol-induced liver damage, and non-alcoholic fatty liver disease (NAFLD; associated with obesity and progressing to non-alcoholic steatohepatitis (NASH)). Asia has an especially high burden of hepatitis virus infections (WHO), and an increased incidence of NAFLD. Despite advances in the prevention and treatment of viral hepatitis (hepatitis B vaccination and hepatitis C combination therapies) the number of people with end-stage liver disease is expected to rise, mainly fueled by the obesity epidemic and aging societies.

Currently, the only curative treatment for end-stage liver disease is liver transplantation. However, donor organs are limited, and end-stage liver disease patients may also experience complications that render them unfit for major surgery. Therefore, alternative strategies to hold off or reverse end-stage liver disease are being pursued. These include cell transplantation, artificial liver devices, and enhancing the organ's endogenous regenerative capacity.

The liver is the only visceral organ that possesses the remarkable capacity to regenerate. It is known that as little as 25% of the original liver mass can regenerate back to its full size. Adult hepatocytes are long-lived and normally do not undergo cell division (Go). However, upon liver damage, they have the ability to enter the cell cycle and proliferate. Once cell proliferation is completed, the newly divided cells undergo restructuring, and other regeneration-related processes such as angiogenesis and reformation of extracellular matrix to complete the regeneration process.

Despite this amazing ability, the regenerative capacity of the liver seems limited, especially under chronic damaging conditions. The ability of the liver to regenerate is central to liver homeostasis. Because the liver is the main site of drug detoxification, it is exposed to many chemicals in the body which may potentially induce cell death and injury. Furthermore, through the enterohepatic circulation, it is exposed to microbiota related metabolites. The liver can regenerate damaged tissue rapidly thereby preventing functional failure. Liver regeneration is also critical for patients with partial removal of the liver due to tumor resection or living-donor transplantation.

In the last three decades, scientists have gained a better understanding of the process of liver regeneration. For example, the cytokines IL6 and TNFα prime the hepatocyte to enter the cell cycle and mitogens such as HGF and EGF are important for driving proliferation. However, the process of promoting the regenerative process is not well understood. Importantly, not only liver intrinsic signals are involved in the regenerative response but also signals from distant organs.

Many different processes are involved to modify the regenerative response, including nutrients, oxygen level and others. Importantly, the complex liver architecture and especially the interaction with other organs cannot be perfectly simulated in vitro and therefore in vivo experiments are essential. The disadvantage of in vivo models is in their limited potential for high throughput drug discovery pipelines, especially compound screens.

Accordingly, there is a need to overcome, or at least to alleviate, one or more of the above-mentioned problems.

SUMMARY OF THE INVENTION

The present invention concerns the treatment and/or prevention of disease through inhibition of genes and/or proteins identified to be upregulated in profibrotic processes. Inhibition of such genes/proteins has protective and regenerative effects.

The present disclosure provides a method of treating or preventing a disease associated with fibrosis, comprising inhibiting at least one of ITFG1, MFAP4, GRHPR, ABCC4, PAK3, TRNP1, APLN, KIF20A, and/or LTB.

Also provided is a method of treating or preventing a disease associated with fibrosis, comprising administering a therapeutically or prophylactically effective amount of an inhibitor of at least one of ITFG1, MFAP4, GRHPR, ABCC4, PAK3, TRNP1, APLN, KIF20A, and/or LTB to a subject.

Also provided is an inhibitor of at least one of ITFG1, MFAP4, GRHPR, ABCC4, PAK3, TRNP1, APLN, KIF20A, and/or LTB for use in a method of treating or preventing a disease associated with fibrosis.

Also provided is the use of an inhibitor of at least one of ITFG1, MFAP4, GRHPR, ABCC4, PAK3, TRNP1, APLN, KIF20A, and/or LTB in the manufacture of a medicament for use in a method of treating or preventing a disease associated with fibrosis.

In some embodiments, the disease is a liver disease or condition.

In some embodiments, the disease or condition is selected from: acute liver disease, chronic liver disease, metabolic liver disease, steatosis, liver fibrosis, primary sclerosing cholangitis (PSC), cirrhosis, mild liver fibrosis, advanced liver fibrosis, non-alcoholic fatty liver disease (NAFLD), non-alcoholic steatohepatitis (NASH), alcoholic fatty liver disease (ALFD), alcohol-related liver disease (ARLD), hepatic ischemia reperfusion injury, primary biliary cirrhosis (PBC), hepatitis, liver damage, liver injury, liver failure, metabolic syndrome, obesity, diabetes mellitus, end-stage liver disease, inflammation of the liver, lobular inflammation, and/or hepatocellular carcinoma (HCC).

In some embodiments, the inhibitor is selected from a nucleic acid, peptide, antibody, antigen-binding molecule or small molecule inhibitor. In some embodiments, the inhibitor is capable of binding to a polypeptide according to any one or more of SEQ ID NO: 7156 to 7178, or to a mRNA according to any one of SEQ ID NO: 7179 to 7195.

In some embodiments, the inhibitor is an inhibitory nucleic acid comprising or encoding antisense nucleic acid having at least 75% sequence identity to any one of SEQ ID NOs: 7179 to 7195, or a portion thereof, or having at least 75% sequence identity to the reverse complement of any one of SEQ ID NOs: 7179 to 7195, or a portion thereof.

In some embodiments, the inhibitor is an inhibitory nucleic acid comprising or encoding antisense nucleic acid comprising or consisting of a nucleotide sequence having at least 75% sequence identity to any one of SEQ ID NO: 1 to 7155, and/or having at least 75% sequence identity to the reverse complement of any one of SEQ ID NOs: 1 to 7155.

In some embodiments, the inhibitor is an inhibitory nucleic acid comprising or encoding antisense nucleic acid comprising or consisting of a nucleotide sequence having at least 75% sequence identity to any one of SEQ ID NO: 6, 7, 457 to 1482, 7095, 7096, 7109 to 7114, 7130 to 7140, 7144, 7145, 7149, 7150, 7154, and/or 7155, and/or having at least 75% sequence identity to the reverse complement of any one of SEQ ID NO: 6, 7, 457 to 1482, 7095, 7096, 7109 to 7114, 7130 to 7140, 7144, 7145, 7149, 7150, 7154, and/or 7155, and optionally wherein the antisense nucleic acid is capable of reducing gene and/or protein expression of ITFG1.

In some embodiments, the inhibitor is an inhibitory nucleic acid comprising or encoding antisense nucleic acid comprising or consisting of a nucleotide sequence having at least 75% sequence identity to any one of SEQ ID NO: 1, 2, 14 to 347, 7092, 7093, 7097 to 7102, 7115 to 7120, 7141, 7142, 7146, 7147, 7151, and/or 7152, and/or having at least 75% sequence identity to the reverse complement of any one of SEQ ID NO: 1, 2, 14 to 347, 7092, 7093, 7097 to 7102, 7115 to 7120, 7141, 7142, 7146, 7147, 7151, and/or 7152, and optionally wherein the antisense nucleic acid is capable of reducing gene and/or protein expression of MFAP4.

In some embodiments, the inhibitor is an inhibitory nucleic acid comprising or encoding antisense nucleic acid comprising or consisting of a nucleotide sequence having at least 75% sequence identity to any one of SEQ ID NO: 3 to 5, 348 to 456, 7094, 7103 to 7108, 7121 to 7129, 7143, 7148, and/or 7153, and/or having at least 75% sequence identity to the reverse complement of any one of SEQ ID NO: 3 to 5, 348 to 456, 7094, 7103 to 7108, 7121 to 7129, 7143, 7148, and/or 7153, and optionally wherein the antisense nucleic acid is capable of reducing gene and/or protein expression of GRHPR.

In some embodiments, the inhibitor is an inhibitory nucleic acid comprising or encoding antisense nucleic acid comprising or consisting of a nucleotide sequence having at least 75% sequence identity to any one of SEQ ID NO: 1483 to 2208, and/or having at least 75% sequence identity to the reverse complement of any one of SEQ ID NO: 1483 to 2208, and optionally wherein the antisense nucleic acid is capable of reducing gene and/or protein expression of ABCC4.

In some embodiments, the inhibitor is an inhibitory nucleic acid comprising or encoding antisense nucleic acid comprising or consisting of a nucleotide sequence having at least 75% sequence identity to any one of SEQ ID NO: 2209 to 5060, and/or having at least 75% sequence identity to the reverse complement of any one of SEQ ID NO: 2209 to 5060, and optionally wherein the antisense nucleic acid is capable of reducing gene and/or protein expression of PAK3.

In some embodiments, the inhibitor is an inhibitory nucleic acid comprising or encoding antisense nucleic acid comprising or consisting of a nucleotide sequence having at least 75% sequence identity to any one of SEQ ID NO: 5061 to 5389, and/or having at least 75% sequence identity to the reverse complement of any one of SEQ ID NO: 5061 to 5389, and optionally wherein the antisense nucleic acid is capable of reducing gene and/or protein expression of TRNP1.

In some embodiments, the inhibitor is an inhibitory nucleic acid comprising or encoding antisense nucleic acid comprising or consisting of a nucleotide sequence having at least 75% sequence identity to any one of SEQ ID NO: 5390 to 5966, and/or having at least 75% sequence identity to the reverse complement of any one of SEQ ID NO: 5390 to 5966, and optionally wherein the antisense nucleic acid is capable of reducing gene and/or protein expression of APLN.

In some embodiments, the inhibitor is an inhibitory nucleic acid comprising or encoding antisense nucleic acid comprising or consisting of a nucleotide sequence having at least 75% sequence identity to any one of SEQ ID NO: 5967 to 6974, and/or having at least 75% sequence identity to the reverse complement of any one of SEQ ID NO: 5967 to 6974, and optionally wherein the antisense nucleic acid is capable of reducing gene and/or protein expression of KIF20A.

In some embodiments, the inhibitor is an inhibitory nucleic acid comprising or encoding antisense nucleic acid comprising or consisting of a nucleotide sequence having at least 75% sequence identity to any one of SEQ ID NO: 6975 to 7091, and/or having at least 75% sequence identity to the reverse complement of any one of SEQ ID NO: 6975 to 7091, and optionally wherein the antisense nucleic acid is capable of reducing gene and/or protein expression of LTB.

In some embodiments, the inhibitory nucleic acid comprises: (i) nucleic acid comprising the nucleotide sequence of one of SEQ ID NO: 1 to 7096 or 7146 to 7150, or a nucleotide sequence having at least 75% sequence identity to one of SEQ ID NO: 1 to 7096 or 7146 to 7150; and (ii) nucleic acid comprising a nucleotide sequence having the reverse complement of the nucleotide sequence of (i), or having at least 75% sequence identity to the reverse complement of the nucleotide sequence of (i).

In some embodiments, the inhibitory nucleic acid comprises one or more modified nucleotides selected from: 2'-O-methyluridine-3-phosphate, 2'-O-methyladenosine-3'-phosphate, 2'-O-methylguanosine-3'-phosphate, 2'-O-methylcytidine-3'-phosphate, 2'-O-methyluridine-3-phosphorothioate, 2'-O-methyladenosine-3'-phosphorothioate, 2'-O-methylguanosine-3'-phosphorothioate, 2'-O-methylcytidine-3'-phosphorothioate, 2'-fluorouridine-3-phosphate, 2'-fluoroadenosine-3-phosphate, 2'-fluoroguanosine-3'-phosphate, 2'-fluorocytidine-3'-phosphate, 2'-fluorocytidine-3'-phosphorothioate, 2'-fluoroguanosine-3'-phosphorothioate, 2'-fluoroadenosine-3'-phosphorothioate, and 2'-fluorouridine-3-phosphorothioate. In some embodiments, the inhibitory nucleic acid comprises: (i) nucleic acid comprising the nucleotide sequence (including the modifications thereto) shown in one of SEQ ID NO: 7146 to 7150; and (ii) nucleic acid comprising the nucleotide sequence (including the modifications thereto) shown in one of SEQ ID NO: 7151 to 7155.

In some embodiments, the inhibitor comprises a moiety facilitating uptake of the inhibitory nucleic acid by hepatocytes. In some embodiments, the nucleic acid inhibitor is an antisense nucleic acid, siRNA, or shRNA.

In some embodiments, the method comprises administering the inhibitor to a subject in which expression and/or activity of one or more of MFAP4, GRHPR, ITFG1, ABCC4, PAK3, TRNP1, APLN, KIF20A, and/or LTB is upregulated.

Also provided is an inhibitory nucleic acid for reducing gene and/or protein expression of ITFG1, wherein the nucleic acid comprises or encodes antisense nucleic acid having at least 75% sequence identity to SEQ ID NO: 7182, or a portion thereof, or having at least 75% sequence identity to the reverse complement of SEQ ID NO: 7182, or a portion thereof.

In some embodiments, the inhibitory nucleic acid comprises or encodes antisense nucleic acid comprising or consisting of a nucleotide sequence having at least 75% sequence identity to any one of SEQ ID NO: 6, 7, 457 to 1482, 7095, 7096, 7109 to 7114, 7130 to 7140, 7144, 7145, 7149, 7150, 7154, and/or 7155, and/or having at least 75% sequence identity to the reverse complement of any one of SEQ ID NO: 6, 7, 457 to 1482, 7095, 7096, 7109 to 7114, 7130 to 7140, 7144, 7145, 7149, 7150, 7154, and/or 7155.

Provided is an inhibitory nucleic acid for reducing gene and/or protein expression of MFAP4, wherein the nucleic acid comprises or encodes antisense nucleic acid having at least 75% sequence identity to SEQ ID NO: 7179 or 7180, or a portion thereof, or having at least 75% sequence identity to the reverse complement of SEQ ID NO: 7179 or 7180, or a portion thereof.

In some embodiments, the inhibitory nucleic acid comprises or encodes antisense nucleic acid comprising or consisting of a nucleotide sequence having at least 75% sequence identity to any one of SEQ ID NO: 1, 2, 14 to 347, 7092, 7093, 7097 to 7102, 7115 to 7120, 7141, 7142, 7146, 7147, 7151, and/or 7152, and/or having at least 75% sequence identity to the reverse complement of any one of SEQ ID NO: 1, 2, 14 to 347, 7092, 7093, 7097 to 7102, 7115 to 7120, 7141, 7142, 7146, 7147, 7151, and/or 7152.

Provided is an inhibitory nucleic acid for reducing gene and/or protein expression of GRHPR, wherein the nucleic acid comprises or encodes antisense nucleic acid having at least 75% sequence identity to SEQ ID NO: 7181, or a portion thereof, or having at least 75% sequence identity to the reverse complement of SEQ ID NO: 7181, or a portion thereof.

In some embodiments, the inhibitory nucleic acid comprises or encodes antisense nucleic acid comprising or consisting of a nucleotide sequence having at least 75% sequence identity to any one of SEQ ID NO: 3 to 5, 348 to 456, 7094, 7103 to 7108, 7121 to 7129, 7143, 7148, and/or 7153, and/or having at least 75% sequence identity to the reverse complement of any one of SEQ ID NO: 3 to 5, 348 to 456, 7094, 7103 to 7108, 7121 to 7129, 7143, 7148, and/or 7153.

Provided is an inhibitory nucleic acid for reducing gene and/or protein expression of ABCC4, wherein the nucleic acid comprises or encodes antisense nucleic acid having at least 75% sequence identity to any one of SEQ ID NO: 7183 to 7186, or a portion thereof, or having at least 75% sequence identity to the reverse complement of any one of SEQ ID NO: 7183 to 7186, or a portion thereof.

In some embodiments, the inhibitory nucleic acid comprises or encodes antisense nucleic acid comprising or consisting of a nucleotide sequence having at least 75% sequence identity to any one of SEQ ID NO: 1483 to 2208, and/or having at least 75% sequence identity to the reverse complement of any one of SEQ ID NO: 1483 to 2208.

Provided is an inhibitory nucleic acid for reducing gene and/or protein expression of PAK3, wherein the nucleic acid comprises or encodes antisense nucleic acid having at least 75% sequence identity to any one of SEQ ID NO: 7187 to 7190, or a portion thereof, or having at least 75% sequence identity to the reverse complement of any one of SEQ ID NO: 7187 to 7190, or a portion thereof.

In some embodiments, the inhibitory nucleic acid comprises or encodes antisense nucleic acid comprising or consisting of a nucleotide sequence having at least 75% sequence identity to any one of SEQ ID NO: 2209 to 5060, and/or having at least 75% sequence identity to the reverse complement of any one of SEQ ID NO: 2209 to 5060.

Provided is an inhibitory nucleic acid for reducing gene and/or protein expression of TRNP1, wherein the nucleic acid comprises or encodes antisense nucleic acid having at least 75% sequence identity to SEQ ID NO: 7191, or a portion thereof, or having at least 75% sequence identity to the reverse complement of SEQ ID NO: 7191, or a portion thereof.

In some embodiments, the inhibitory nucleic acid comprises or encodes antisense nucleic acid comprising or consisting of a nucleotide sequence having at least 75% sequence identity to any one of SEQ ID NO: 5061 to 5389, and/or having at least 75% sequence identity to the reverse complement of any one of SEQ ID NO: 5061 to 5389.

Provided is an inhibitory nucleic acid for reducing gene and/or protein expression of APLN, wherein the nucleic acid comprises or encodes antisense nucleic acid having at least 75% sequence identity to SEQ ID NO: 7192, or a portion thereof, or having at least 75% sequence identity to the reverse complement of SEQ ID NO: 7192, or a portion thereof.

In some embodiments, the inhibitory nucleic acid comprises or encodes antisense nucleic acid comprising or consisting of a nucleotide sequence having at least 75% sequence identity to any one of SEQ ID NO: 5390 to 5966, and/or having at least 75% sequence identity to the reverse complement of any one of SEQ ID NO: 5390 to 5966.

Provided is an inhibitory nucleic acid for reducing gene and/or protein expression of KIF20A, wherein the nucleic acid comprises or encodes antisense nucleic acid having at least 75% sequence identity to SEQ ID NO: 7193, or a portion thereof, or having at least 75% sequence identity to the reverse complement of SEQ ID NO: 7193, or a portion thereof.

In some embodiments, the inhibitory nucleic acid comprises or encodes antisense nucleic acid comprising or consisting of a nucleotide sequence having at least 75% sequence identity to any one of SEQ ID NO: 5967 to 6974, and/or having at least 75% sequence identity to the reverse complement of any one of SEQ ID NO: 5967 to 6974.

Provided is an inhibitory nucleic acid for reducing gene and/or protein expression of LTB, wherein the nucleic acid comprises or encodes antisense nucleic acid having at least 75% sequence identity to SEQ ID NO: 7194 or 7195, or a portion thereof, or having at least 75% sequence identity to the reverse complement of SEQ ID NO: 7194 or 7195, or a portion thereof.

In some embodiments, the inhibitory nucleic acid comprises or encodes antisense nucleic acid comprising or consisting of a nucleotide sequence having at least 75% sequence identity to any one of SEQ ID NO: 6975 to 7091, and/or having at least 75% sequence identity to the reverse complement of any one of SEQ ID NO: 6975 to 7091.

Also provided is an inhibitory nucleic acid comprising (i) nucleic acid comprising the nucleotide sequence shown in one of SEQ ID NO: 7092 to 7096; and (ii) nucleic acid comprising the nucleotide sequence shown in one of SEQ ID NO: 7141 to 7145.

In some embodiments, the inhibitory nucleic acid comprises one or more modified nucleotides selected from: 2'-O-methyluridine-3-phosphate, 2'-O-methyladenosine-3'-phosphate, 2'-O-methylguanosine-3'-phosphate, 2'-O-methylcytidine-3'-phosphate, 2'-O-methyluridine-3'-phosphorothioate, 2'-O-methyladenosine-3'-phosphorothioate, 2'-O-methylguanosine-3'-phosphorothioate, 2'-O-methylcytidine-3'-phosphorothioate, 2'-fluorouridine-3-phosphate, 2'-fluoroadenosine-3-phosphate, 2'-fluoroguanosine-3'-phosphate, 2'-fluorocytidine-3'-phosphate, 2'-fluorocytidine-3'-phosphorothioate, 2'-fluoroguanosine-3'-phosphorothioate, 2'-fluoroadenosine-3'-phosphorothioate, and 2'-fluorouridine-3'-phosphorothioate.

Also provided is inhibitory nucleic acid comprising (i) nucleic acid comprising the nucleotide sequence (including the modifications thereto) shown in one of SEQ ID NO: 7146 to 7150; and (ii) nucleic acid comprising the nucleotide sequence (including the modifications thereto) shown in one of SEQ ID NO: 7151 to 7155.

In some embodiments, the inhibitory nucleic acid further comprises a moiety facilitating uptake of the inhibitory nucleic acid by hepatocytes. In some embodiments, the inhibitory nucleic acid is an antisense nucleic acid, siRNA or shRNA.

The present disclosure also provides a nucleic acid, optionally isolated, encoding an inhibitory nucleic acid according to the present disclosure.

The present disclosure also provides an expression vector, comprising a nucleic acid according to the present disclosure.

The present disclosure also provides a composition comprising an inhibitory nucleic acid, a nucleic acid, or an expression vector according to the present disclosure, and a pharmaceutically acceptable carrier, diluent, excipient or adjuvant.

The present disclosure also provides a cell comprising an inhibitory nucleic acid, a nucleic acid, or an expression vector according to the present disclosure.

The present disclosure also provides a method of treating or preventing a disease according to the present disclosure, comprising administering a therapeutically or prophylactically effective amount of an inhibitor, an inhibitory nucleic acid, a nucleic acid, an expression vector, a composition, or a cell according to the present disclosure to a subject.

The present disclosure also provides an inhibitor, an inhibitory nucleic acid, a nucleic acid, an expression vector, a composition, or a cell according to the present disclosure for use in therapy. In some embodiments, the inhibitor, inhibitory nucleic acid, nucleic acid, expression vector, composition, or cell is provided for use in a method of treating or preventing a disease, e.g. a disease according to the present disclosure.

The present disclosure also provides the use of an inhibitor, an inhibitory nucleic acid, a nucleic acid, an expression vector, a composition, or a cell according to the present disclosure in the manufacture of a medicament for use in a method of treating or preventing a disease, e.g. a disease according to the present disclosure.

Also disclosed is an in vitro or in vivo method for reducing gene and/or protein expression of one or more of ITFG1, MFAP4, GRHPR, ABCC4, PAK3, TRNP1, APLN, KIF20A, and/or LTB in a cell, comprising introducing an inhibitory nucleic acid, a nucleic acid, or an expression vector according to the present disclosure into a cell.

Also disclosed is a method of regenerating liver tissue in vitro or in vivo, the method comprising inhibiting at least one of ITFG1, MFAP4, GRHPR, ABCC4, PAK3, TRNP1, APLN, KIF20A, and/or LTB in a cell of the tissue.

Also disclosed is a method of proliferating/expanding a hepatocyte in vitro or in vivo, the method comprising inhibiting at least one of ITFG1, MFAP4, GRHPR, ABCC4, PAK3, TRNP1, APLN, KIF20A, and/or LTB in the hepatocyte.

In some embodiments, a method disclosed herein comprises introducing an inhibitory nucleic acid, a nucleic acid, or an expression vector according to the present disclosure into a cell, e.g. a cell of the tissue or a hepatocyte.

Disclosed herein is a method of stimulating or increasing proliferation and/or regeneration of a cell in a subject, the method comprising administering to the subject an inhibitor of a gene or corresponding gene product associated with organ regeneration for a sufficient time and under conditions to stimulate or increase proliferation and/or regeneration of the cell in the subject.

Disclosed herein is a method of enhancing cell function in a subject, the method comprising administering to the subject an inhibitor of a gene or corresponding gene product associated with organ regeneration for a sufficient time and under conditions to enhance cell function in the subject.

Disclosed herein is a method of enhancing cell viability in a subject, the method comprising administering to the subject an inhibitor of a gene or corresponding gene product associated with organ regeneration for a sufficient time and under conditions to enhance cell viability in the subject.

Disclosed herein is a method of treating a liver condition or disease in a subject, the method comprising administering to the subject an inhibitor of a gene or corresponding gene product associated with organ regeneration for a sufficient time and under conditions to treat the liver condition or disease in the subject.

Disclosed herein is a method of protecting a subject from liver damage, the method comprising administering to the subject an inhibitor of a gene or corresponding gene product associated with organ regeneration for a sufficient time and under conditions to protect the subject from liver damage.

Disclosed herein is a method of detecting a liver condition or disease in a subject, the method comprising detecting in a sample the level of one or more biomarkers associated with organ regeneration, wherein a change in the level of the one or more biomarkers as compared to a reference indicates that the subject is suffering from a liver condition or disease.

Disclosed herein is an inhibitor of a gene or corresponding gene product associated with organ regeneration for use in preventing or treating a liver condition or disease in the subject.

Disclosed herein is the use of an inhibitor of a gene or corresponding gene product associated with organ regeneration in the manufacture of a medicament for preventing or treating a liver condition or disease in the subject.

The methods disclosed herein may employ any suitable inhibitor. In some embodiments, the inhibitor is an inhibitor according to the present disclosure.

Disclosed herein is a nucleic acid inhibitor consisting, comprising or encoding an RNAi agent having at least 70%, 80%, 90% or 95% sequence identity to an RNA sequence listed in any of Tables 1-14 or an RNAi agent that hybridizes to the complement of an RNA sequence listed in any of Tables 1-14 under stringency conditions.

Disclosed herein is a method of screening for an inhibitor of a gene or corresponding gene product associated with organ regeneration by: a) contacting the gene or corresponding gene product with a chemical compound library, and b) identifying a chemical compound within the library that is binds to the gene or corresponding gene product to inhibit the expression or function of the gene or corresponding gene product.

The invention includes the combination of the aspects and preferred features described except where such a combination is clearly impermissible or expressly avoided.

DETAILED DESCRIPTION

The present invention relates to the identification of proteins that are involved in the development of liver disease and/or are detrimental to liver regeneration after injury, and targeting such proteins to treat liver diseases.

Without being bound by theory, the inventors have used an unbiased in vivo functional genetic screen to identify new therapeutic targets that are upregulated in liver diseases and conditions associated with fibrosis. Enrichment of target shRNAs indicates that the knockdown/inhibition of these targets gives a survival advantage to hepatocytes under a chronic liver damaging condition. As enrichment indicates a relative expansion to the control, knockdown or inhibition of the identified genes supports hepatocyte expansion, proliferation and robustness. This is therapeutically beneficial for liver disease interception, accelerating liver regeneration, protecting against liver damage, promoting cell proliferation, stopping and reversing liver fibrosis, and increasing survival.

Targets

The present disclosure relates to inhibition of gene and/or protein expression of one or more of MFAP4, GRHPR, ITFG1, ABCC4, PAK3, TRNP1, APLN, KIF20A, and/or LTB. Any one or combination of these genes (i.e. any one, two, three, four, five, six, seven, eight or all nine) may be inhibited in the methods provided herein. Any one or combination of these genes may be referred to herein as a target gene(s), target mRNA(s), or target protein(s). One or more of MFAP4, GRHPR, ITFG1, ABCC4, PAK3, TRNP1, APLN, KIF20A, and/or LTB may be described herein as a "gene or corresponding gene product associated with organ regeneration".

MFAP4, GRHPR and ITFG1 are found in recurrent amplifications in hepatocellular carcinoma (Nat Med. 2014 October; 20(10): 1138-1146). ABCC4, PAK3, TRNP1, APLN, KIF20A and LTB were all found by the present inventors to be dysregulated in a local patient cohort with non-alcoholic fatty liver disease (NAFLD). Microfibril-associated glycoprotein 4 (MFAP4) is an extracellular matrix protein belonging to the fibrinogen-related domain (FReD) superfamily. Human MFAP4 is identified by UniProtKB P55083.

MFAP4 structure and function is described in e.g. Pilecki B., et al., J. Biol. Chem. 291:1103-1114 (2016), which is hereby incorporated by reference in its entirety.

MFAP4 is an extracellular glycoprotein found in elastic fibres and is required for proper elastic fibre organisation. It specifically binds tropoelastin and fibrillin-1 and -2, as well as the elastin cross-linking amino acid desmosine, and it co-localizes with fibrillin-1-positive fibres in vivo. Human MFAP4 has been localized to elastic fibres in a variety of elastic tissues, including aorta, skin, and lung.

MFAP4 is closely associated with remodelling-related diseases, including liver fibrosis, atherosclerosis, arterial injury stimulated remodelling, and asthma (Wang H B et al., J Am Heart Assoc. 2020; 9(17):e015307). Pan Z et al., FASEB J. 2020, 34(11):14250-14263 reported that MFAP4 deficiency alleviates renal fibrosis by inhibiting the activation of NF-κB and TGF-β/Smad signalling pathways and downregulating the expression of fibrosis-related proteins. MFAP4 is produced by activated myofibroblasts and may be a predictive biomarker for severity of hepatic fibrosis (Madsen B S et al., Liver Int. 2020; 40(7): 1701-1712; Seekmose S G, et al., PLoS One. 2015; 10(10):e0140418). Example 2 of the present application shows that genes known to be involved in liver regeneration, e.g. Ptgs2, Areg, Dhrs9, Hmox1 and Nqo1, are upregulated after Mfap4 knockdown.

Alternative splicing of the mRNA transcribed from the human MFAP4 gene yields two isoforms: isoform 1 (UniProtKB: P55083-1, v2; SEQ ID NO: 7156), and isoform 2 (UniProtKB: P55083-2; SEQ ID NO: 7157) in which the amino acid sequence corresponding to positions 1 to 2 of SEQ ID NO: 7156 are replaced with the sequence 'MGELSPLQRPLATEGTMKAQGVLLKL'.

The 255-amino acid sequence of human MFP4 isoform 1 comprises an N-terminal signal peptide at positions 1-21 of SEQ ID NO: 7156 and the mature protein region at positions 22-255 of SEQ ID NO: 7156. Positions 26-28 of SEQ ID NO: 7156 constitute the cell attachment site and positions 32-255 of SEQ ID NO: 7156 constitute the fibrinogen C-terminal domain.

In this specification, reference to 'MFAP4' encompasses: human MFAP4, isoforms of human MFAP4, homologues of human MFAP4 (i.e. encoded by the genome of a non-human animal), and variants thereof. In some embodiments, MFAP4 according to the present disclosure comprises or consists of an amino acid sequence having at 70% or greater amino acid sequence identity, preferably one of 75%, 80%, 85%, 90%, 91%, 92%, 93%, 94%, 95%, 96%, 97%, 98%, 99% or 100% amino acid sequence identity to the amino acid sequence of SEQ ID NO: 7156.

Glyoxylate reductase/hydroxypyruvate reductase (GRHPR) is an NADPH/NADH dependent enzyme with hydroxy-pyruvate reductase, glyoxylate reductase and D-glycerate dehydrogenase enzymatic activities. It reduces toxic intermediate glyoxylate to easily-excreted glycolate and reduces hydroxypyruvate into D-glycerate for use in glucose synthesis. Deficiency of GRHPR is the underlying cause of primary hyperoxaluria type 2 (PH2) and leads to increased urinary oxalate levels, formation of kidney stones and renal failure (Cregeen D P et al., Hum Mol Genet. 1999; 8(11):2063-9). Human GRHPR is identified by UniProtKB Q9UBQ7.

GRHPR structure and function is described in e.g. Rumsby G. and Cregeen D. P. Biochim. Biophys. Acta 1446: 383-388 (1999), and Booth et al., J Mol Biol, 2006; 360(1): 178-89, which are hereby incorporated by reference in their entirety.

Alternative splicing of the mRNA transcribed from the human GRHPR gene yields two isoforms: isoform 1 (UniProtKB: Q9UBQ7-1, v1; SEQ ID NO: 7158), and isoform 2 (UniProtKB: Q9UBQ7-2; SEQ ID NO: 7159) in which the amino acid sequence corresponding to positions 1 to 21 of SEQ ID NO: 7158 are replaced with the sequence 'MLGGVPTLCGTGNETWTLLAL', positions 22-164 of SEQ ID NO: 7158 are missing, and positions 246-328 of SEQ ID NO: 7158 are replaced with the sequence 'YPRATLPSKPGEEPSPLLPSGDFLPRGLLVRPQAEL-AGFHKPNNQLRNSWEYTRPPYREEEPSEWAWP VCFSAVAPTRRGLAHSSVASGSVPREPLQAHY-
PPPQRAGLEDLKGPLEAASHTAE-
PGFVWLWFSDTLNL MLLGGQTLKLTWS'.

The 328-amino acid sequence of human GRHPR isoform 1 comprises NADP binding sites at positions 217, 243, 162-164, 185-188 and 295 of SEQ ID NO: 7158, and substrate (glyoxylate/hydroxypyruvate) binding sites at positions 83-84, 245, 269, and 293-296 of SEQ ID NO: 7158.

In this specification, reference to 'GRHPR' encompasses: human GRHPR, isoforms of human GRHPR, homologues of human GRHPR (i.e. encoded by the genome of a non-human animal), and variants thereof. In some embodiments, GRHPR according to the present disclosure comprises or consists of an amino acid sequence having at 70% or greater amino acid sequence identity, preferably one of 75%, 80%, 85%, 90%, 91%, 92%, 93%, 94%, 95%, 96%, 97%, 98%, 99% or 100% amino acid sequence identity to the amino acid sequence of SEQ ID NO: 7158.

T-cell immunomodulatory protein (ITFG1; also known as Protein TIP, Integrin-alpha FG-GAP repeat-containing protein 1, or Linkin/LNKN-1) is a modulator of T cell function. Human ITFG1 is identified by UniProtKB Q8TB96.

ITFG1 structure and function is described in e.g. Fiscella M., et al., Nat. Biotechnol. 21:302-307 (2003), which is hereby incorporated by reference in its entirety. Treatment of primary human and murine T cells with ITFG1 in vitro resulted in the secretion of IFN-gamma, TNF-alpha, and IL-10, whereas in vivo ITFG1 reportedly has a protective effect in a mouse acute graft-versus-host disease (GVHD) model. The interaction between ITFG1 and the ATPase RUVBL1 is reported to be required for breast cancer cell invasion and progression (Fan W. et al., Biochim Biophys Acta Gen Subj. 2017; 1861(7):1788-1800).

The 612-amino acid sequence of human ITFG1 is shown in SEQ ID NO: 7160 (UniprotKB: Q8TB96-1, v1). This sequence comprises: an N-terminal signal peptide at positions 1-33 of SEQ ID NO: 7160, an FG-GAP repeat at positions 258-293 of SEQ ID NO: 7160, and a transmembrane domain at positions 567-587 of SEQ ID NO: 7160.

In this specification, reference to 'ITFG1' encompasses: human ITFG1, isoforms of human ITFG1, homologues of human ITFG1 (i.e. encoded by the genome of a non-human animal), and variants thereof. In some embodiments, ITFG1 according to the present disclosure comprises or consists of an amino acid sequence having at 70% or greater amino acid sequence identity, preferably one of 75%, 80%, 85%, 90%, 91%, 92%, 93%, 94%, 95%, 96%, 97%, 98%, 99% or 100% amino acid sequence identity to the amino acid sequence of SEQ ID NO: 7160.

ATP-binding cassette sub-family C member 4 (ABCC4; also known as multidrug resistance protein 4 (MRP4)) is an ATP-dependent transporter of the ATP-binding cassette (ABC) family that actively extrudes physiological compounds and xenobiotics from cells. It transports a range of endogenous molecules that have a key role in cellular communication and signalling, including cyclic nucleotides such as cyclic AMP (cAMP) and cyclic GMP (cGMP), bile acids, steroid conjugates, urate, and prostaglandins. It is expressed in several tissues, including hepatocytes, with highest expression in the kidney and choroid plexus (Maher J M, et al., Drug Metab. Dispos., 33 (2005), pp. 947-955). Human ABCC4 is identified by UniProtKB 015439.

ABCC4 structure and function is described in e.g. Russel et al., Trends Pharmacol Sci. 2008, 29(4):200-7, which is hereby incorporated by reference in its entirety. ABCC4 is an inducible gene in the liver following toxic acetaminophen exposure in both humans and rodents. In mice, ABCC4 deficiency is linked to increased risk of liver injury, altered gut epithelial function and altered drug disposition, although protein expression is reportedly increased in human livers with steatosis, alcoholic cirrhosis, and diabetic cirrhosis (More V R et al., Drug Metab Dispos. 2013; 41(5): 1148-1155).

Alternative splicing of the mRNA transcribed from the human ABCC4 gene yields four isoforms: isoform 1 (UniProtKB: 015439-1, v3; SEQ ID NO: 7161), isoform 2 (015439-2, SEQ ID NO: 7162) in which the amino acid sequence corresponding to positions 679-725 of SEQ ID NO: 7161 are missing, isoform 3 (015439-3, SEQ ID NO: 7163) in which the amino acid sequence corresponding to positions 846-859 of SEQ ID NO: 7161 are replaced with the sequence 'RWDLAVLSWLVSNS' and positions 860-1325 of SEQ ID NO: 7161 are missing, and isoform 4 (015439-4, SEQ ID NO: 7164) in which the amino acid sequence corresponding to positions 103-177 of SEQ ID NO: 7161 are missing, the amino acid sequence corresponding to positions 846-859 of SEQ ID NO: 7161 are replaced with the sequence 'RWDLAVLSWLVSNS', and the amino acid sequence corresponding to positions 860-1325 of SEQ ID NO: 7161 are missing.

The 1325-amino acid sequence of human ABCC4 isoform 1 comprises: an ABC transmembrane type-1 1 domain at positions 92-377, an ABC transporter 1 domain at positions 410-633, an ABC transmembrane type-1 2 domain at positions 714-1005, an ABC transporter 2 domain at positions 1041-1274, and ATP binding regions at positions 445-452 and 1075-1082 of SEQ ID NO: 7161.

In this specification, reference to 'ABCC4' encompasses: human ABCC4, isoforms of human ABCC4, homologues of human ABCC4 (i.e. encoded by the genome of a non-human animal), and variants thereof. In some embodiments, ABCC4 according to the present disclosure comprises or consists of an amino acid sequence having at 70% or greater amino acid sequence identity, preferably one of 75%, 80%, 85%, 90%, 91%, 92%, 93%, 94%, 95%, 96%, 97%, 98%, 99% or 100% amino acid sequence identity to the amino acid sequence of SEQ ID NO: 7161.

p21-activated kinase 3 (PAK3; also known as Serine/threonine-protein kinase PAK 3, Beta-PAK or Oligophrenin-3) is a serine/threonine protein kinase that plays a role in a variety of different signalling pathways including cytoskeleton regulation, cell migration, or cell cycle regulation. Activation by the binding of active CDC42 and RAC1 results in a conformational change and a subsequent autophosphorylation on several serine and/or threonine residues. It phosphorylates MAPK4 and MAPK6 and activates the downstream target MAPKAPK5, a regulator of F-actin polymerization and cell migration. PAK3 is also a core mediator of integrin beta-1 signalling (a critical mediator of HSC activation and progression of fibrotic disease). Human PAK3 is identified by UniProtKB O75914.

PAK3 structure and function is described in e.g. Deleris P., et al., J. Biol. Chem. 286:6470-6478 (2011) and Chong C. et al., J. Biol. Chem. 276:17347-17353 (2001), which are both hereby incorporated by reference in their entirety.

Alternative splicing of the mRNA transcribed from the human PAK3 gene yields four isoforms: isoform 1 (UniProtKB: O75914-1, v2; SEQ ID NO: 7165), isoform 2 (O75914-2, SEQ ID NO: 7166) in which the amino acid sequence corresponding to positions 93-107 of SEQ ID NO: 7165 are missing, isoform 3 (O75914-3, SEQ ID NO: 7167) in which the amino acid at position 92 of SEQ ID NO: 7165 is replaced with the sequence 'TNSPFQTSRPVT- VASSQSEGKM', and isoform 4 (O75914-4, SEQ ID NO: 7168) in which the amino acid sequence corresponding to positions 92-107 of SEQ ID NO: 7165 are replaced with the sequence 'TNSPFQTSRPVTVASSQSEGKM'.

The 559-amino acid sequence of human PAK3 isoform 1 comprises: a CRIB domain at positions 70-83 and a protein kinase domain at positions 283-534 of SEQ ID NO: 7165.

In this specification, reference to 'PAK3' encompasses: human PAK3, isoforms of human PAK3, homologues of human PAK3 (i.e. encoded by the genome of a non-human animal), and variants thereof. In some embodiments, PAK3 according to the present disclosure comprises or consists of an amino acid sequence having at 70% or greater amino acid sequence identity, preferably one of 75%, 80%, 85%, 90%, 91%, 92%, 93%, 94%, 95%, 96%, 97%, 98%, 99% or 100% amino acid sequence identity to the amino acid sequence of SEQ ID NO: 7165.

TMF-regulated nuclear protein 1 (TRNP1) is a DNA-binding factor that regulates the expression of a subset of genes and plays a key role in tangential, radial, and lateral expansion of the brain neocortex. Human TRNP1 is identified by UniProtKB Q6NT89.

TRNP1 structure and function is described in e.g. Stahl R. et al., Cell 153:535-549 (2013), which is hereby incorporated by reference in its entirety.

The 227-amino acid sequence of human TRNP1 is shown in SEQ ID NO: 7169 (UniprotKB: Q6NT89-1, v2).

In this specification, reference to 'TRNP1' encompasses: human TRNP1, isoforms of human TRNP1, homologues of human TRNP1 (i.e. encoded by the genome of a non-human animal), and variants thereof. In some embodiments, TRNP1 according to the present disclosure comprises or consists of an amino acid sequence having at 70% or greater amino acid sequence identity, preferably one of 75%, 80%, 85%, 90%, 91%, 92%, 93%, 94%, 95%, 96%, 97%, 98%, 99% or 100% amino acid sequence identity to the amino acid sequence of SEQ ID NO: 7169.

Apelin (APLN) is a peptide ligand for the G-protein coupled apelin receptor (APLNR). The APLN system plays important and various roles in the physiology and pathophysiology of many organs, including regulation of blood pressure, cardiac contractility, angiogenesis, metabolic balance, and cell proliferation, apoptosis or inflammation. Apelin is expressed in the heart, endothelium, vascular smooth muscle cells (VSMCs), brain, kidney, testis, ovary, liver and adipose tissue, with the highest expression levels in the lung and the mammary gland. Human APLN is identified by UniProtKB Q9ULZ1.

APLN structure and function is described in e.g. Tatemoto K. et al., Biochem. Biophys. Res. Commun. 251:471-476 (1998), and Lee D. K. et al., J. Neurochem. 74:34-41 (2000), which are both hereby incorporated by reference in their entirety.

The 77-amino acid sequence of human APLN is shown in SEQ ID NO: 7170 (UniprotKB: Q9ULZ1-1, v1). SEQ ID NO: 7170 encompasses a signal peptide at positions 1-22 and a propeptide at positions 23-41. SEQ ID NO: 7170 is cleaved into one or more active peptides by proteolytic processing: Apelin-36 (SEQ ID NO: 7171) at positions 42-77 of SEQ ID NO: 7170, Apelin-31 (SEQ ID NO: 7172) at positions 47-77 of SEQ ID NO: 7170, Apelin-28 (SEQ ID NO: 7173) at positions 50-77 of SEQ ID NO: 7170, or Apelin-13 (SEQ ID NO: 7174) at positions 65-77 of SEQ ID NO: 7170.

In this specification, reference to 'APLN' encompasses: human APLN, isoforms of human APLN, homologues of human APLN (i.e. encoded by the genome of a non-human animal), proteolytic peptides derived from human APLN, and variants thereof. In some embodiments, APLN according to the present disclosure comprises or consists of an amino acid sequence having at 70% or greater amino acid sequence identity, preferably one of 75%, 80%, 85%, 90%, 91%, 92%, 93%, 94%, 95%, 96%, 97%, 98%, 99% or 100% amino acid sequence identity to the amino acid sequence of SEQ ID NO: 7170.

Kinesin-like protein KIF20A (also known as GG10_2, Mitotic kinesin-like protein 2 (MKlp2), Rab6-interacting kinesin-like protein (RAB6KIFL), Rabkinesin-6) is a mitotic kinesin required for chromosome passenger complex (CPC)-mediated cytokinesis. KIF20A is a target for polo-like kinase 1 (Plk1), and phosphorylated KIF20A binds to the polo box domain of Plk1. Phosphorylation of KIF20A by Plk1 is necessary for the spatial restriction of Plk1 to the central spindle during anaphase and telophase, and the complex of these two proteins is required for cytokinesis. Human KIF20A is identified by UniProtKB O95235.

KIF20A structure and function is described in e.g. Neef R. et al., J Cell Biol. 2003; 162(5): 863-75, which is hereby incorporated by reference in its entirety.

Alternative splicing of the mRNA transcribed from the human KIF20A gene yields two isoforms: isoform 1 (UniProtKB: O95235-1, v1; SEQ ID NO: 7175), and isoform 2 (UniProtKB: O95235-2; SEQ ID NO: 7176) in which the amino acid sequence corresponding to positions 65-82 of SEQ ID NO: 7175 are missing.

The 890-amino acid sequence of human KIF20A isoform 1 comprises: a kinesin motor domain at positions 64-507 and a coiled coil domain at positions 611-762 of SEQ ID NO: 7175.

In this specification, reference to 'KIF20A' encompasses: human KIF20A, isoforms of human KIF20A, homologues of human KIF20A (i.e. encoded by the genome of a non-human animal), and variants thereof.

In some embodiments, KIF20A according to the present disclosure comprises or consists of an amino acid sequence having at 70% or greater amino acid sequence identity, preferably one of 75%, 80%, 85%, 90%, 91%, 92%, 93%, 94%, 95%, 96%, 97%, 98%, 99% or 100% amino acid sequence identity to the amino acid sequence of SEQ ID NO: 7175.

Lymphotoxin-beta (LTB, also known as Tumor necrosis factor C (TNF-C), Tumor necrosis factor ligand superfamily member 3) is a pro-inflammatory cytokine belonging to the TNF family that binds to receptors LTBR/TNFRSF3. It participates in the regulation of immune and inflammatory responses and, along with other LT-related cytokines such as LT-alpha, TNFα and LIGHT (TNFSF14) and their receptors, plays a role in the development and homeostasis of secondary lymphoid organs. Human LTB is identified by UniProtKB Q06643.

LTB structure and function is described in e.g. Sudhamsu J., et al., Proc Natl Acad Sci USA 110:19896-19901 (2013); Browning J. L., et al., Cell 72:847-856 (1993), Neville M. J. & Campbell R. D. J. Immunol. 162:4745-4754 (1999); Crowe P. D. et al., Science. 1994; 264(5159):707-10; and Bjordahl R. L. et al., Curr Opin Immunol. 2013, 25(2): 222-229, which are all hereby incorporated by reference in their entirety.

Alternative splicing of the mRNA transcribed from the human LTB gene yields two isoforms: isoform 1 (UniProtKB: Q06643-1, v1; SEQ ID NO: 7177), and isoform 2 (UniProtKB: Q06643-2; SEQ ID NO: 7178) in which the amino acid sequence corresponding to positions 53-77 of SEQ ID NO: 7177 are replaced with the sequence 'GLG- FRSCQRRSQKQISAPGSQLPTS' and positions 78-244 of SEQ ID NO: 7177 are missing.

The 244-amino acid sequence of human LTB isoform 1 comprises: a cytoplasmic domain at positions 1-18, a transmembrane domain at positions 19-48, and an extracellular domain at positions 49-244 of SEQ ID NO: 7177.

In this specification, reference to 'LTB' encompasses: human LTB, isoforms of human LTB, homologues of human LTB (i.e. encoded by the genome of a non-human animal), and variants thereof. In some embodiments, LTB according to the present disclosure comprises or consists of an amino acid sequence having at 70% or greater amino acid sequence identity, preferably one of 75%, 80%, 85%, 90%, 91%, 92%, 93%, 94%, 95%, 96%, 97%, 98%, 99% or 100% amino acid sequence identity to the amino acid sequence of SEQ ID NO: 7177.

As used herein, a "fragment", "variant" or "homologue" of a protein may optionally be characterised as having at least 60%, preferably one of 70%, 75%, 80%, 85%, 90%, 91%, 92%, 93%, 94%, 95%, 96%, 97%, 98%, 99% or 100% amino acid sequence identity to the amino acid sequence of the reference protein (e.g. a reference isoform). In some embodiments, fragments, variants, isoforms and homologues of a reference protein may be characterised by ability to perform a function performed by the reference protein.

A "fragment" generally refers to a fraction of the reference protein. A "variant" generally refers to a protein having an amino acid sequence comprising one or more amino acid substitutions, insertions, deletions or other modifications relative to the amino acid sequence of the reference protein, but retaining a considerable degree of sequence identity (e.g. at least 60%) to the amino acid sequence of the reference protein. An "isoform" generally refers to a variant of the reference protein expressed by the same species as the species of the reference protein. A "homologue" generally refers to a variant of the reference protein produced by a different species as compared to the species of the reference protein. Homologues include orthologues.

A "fragment" may be of any length (by number of amino acids), although may optionally be at least 20% of the length of the reference protein (that is, the protein from which the fragment is derived) and may have a maximum length of one of 50%, 75%, 80%, 85%, 90%, 91%, 92%, 93%, 94%, 95%, 96%, 97%, 98%, or 99% of the length of the reference protein.

In some embodiments, the target gene/protein (i.e. MFAP4, GRHPR, ITFG1, ABCC4, PAK3, TRNP1, APLN, KIF20A, and/or LTB) is a target gene/protein from a mammal (any species in the class Mammalia, e.g. a primate (rhesus, cynomolgous, non-human primate or human) and/or a rodent (e.g. rat or mouse).

Isoforms, fragments, variants or homologues of MFAP4, GRHPR, ITFG1, ABCC4, PAK3, TRNP1, APLN, KIF20A, and/or LTB may optionally be characterised as having at least 70%, preferably one of 80%, 85%, 90%, 91%, 92%, 93%, 94%, 95%, 96%, 97%, 98%, 99% or 100% amino acid sequence identity to the amino acid sequence of an immature or mature MFAP4, GRHPR, ITFG1, ABCC4, PAK3, TRNP1, APLN, KIF20A, and/or LTB isoform from a given species, e.g. human.

A homologue of a human gene described herein may be from any animal. In some embodiments, a homologue of a human gene described herein may be from a mammal. In some embodiments, the mammal may be a non-human mammal, e.g. a primate (e.g. a non-human primate, e.g. an animal of the genus *Macaca* (e.g. *Macaca fascicularis*, *Macaca mulatta*), e.g. a non-human hominid (e.g. *Pan troglodytes*)). In some embodiments, the mammal may be a rabbit, guinea pig, rat, mouse or animal of the order Rodentia, cat, dog, pig, sheep, goat, an animal of the order Bos (e.g. cattle), an animal of the family Equidae (e.g. horse) or donkey.

Homologues of a human protein described herein may optionally be characterised as having 70% or greater amino acid sequence identity, preferably one of 75%, 80%, 85%, 90%, 91%, 92%, 93%, 94%, 95%, 96%, 97%, 98%, 99% or 100% amino acid sequence identity to the amino acid sequence of SEQ ID NOs: 7156 to 7178. Variants of a human protein described herein may optionally be characterised as having 70% or greater amino acid sequence identity, preferably one of 75%, 80%, 85%, 90%, 91%, 92%, 93%, 94%, 95%, 96%, 97%, 98%, 99% or greater amino acid sequence identity to the amino acid sequence of SEQ ID NOs: 7156 to 7178.

Isoforms, fragments, variants or homologues may optionally be functional isoforms, fragments, variants or homologues, e.g. having a functional property/activity of the reference MFAP4, GRHPR, ITFG1, ABCC4, PAK3, TRNP1, APLN, KIF20A, and/or LTB, as determined by analysis by a suitable assay for the functional property/activity.

Inhibition of Targets

The present invention is concerned with inhibition of MFAP4, GRHPR, ITFG1, ABCC4, PAK3, TRNP1, APLN, KIF20A, and/or LTB (i.e. a target gene/protein described herein). That is, the invention is concerned with inhibition of the expression and/or activity of MFAP4, GRHPR, ITFG1, ABCC4, PAK3, TRNP1, APLN, KIF20A, and/or LTB and the downstream functional consequences thereof.

Inhibition of MFAP4, GRHPR, ITFG1, ABCC4, PAK3, TRNP1, APLN, KIF20A, and/or LTB encompasses decreased/reduced expression (gene and/or protein expression) of any one or more of MFAP4, GRHPR, ITFG1, ABCC4, PAK3, TRNP1, APLN, KIF20A, and/or LTB, and/or decreased/reduced activity of any one or more of MFAP4, GRHPR, ITFG1, ABCC4, PAK3, TRNP1, APLN, KIF20A, and/or LTB, relative to the level of expression/activity observed in the absence of inhibition. "Inhibition" may herein also be referred to as "antagonism". Any one, two, three, four, five, six, seven, eight or nine of the genes/proteins may be inhibited in the methods according to the present disclosure.

In some embodiments, inhibition of MFAP4, GRHPR, ITFG1, ABCC4, PAK3, TRNP1, APLN, KIF20A, and/or LTB may be characterised by one or more of the following (relative to the uninhibited state):
  Reduce expression (e.g. gene and/or protein expression) of MFAP4, GRHPR, ITFG1, ABCC4, PAK3, TRNP1, APLN, KIF20A, and/or LTB;
  Reduce the level of RNA encoding MFAP4, GRHPR, ITFG1, ABCC4, PAK3, TRNP1, APLN, KIF20A, and/or LTB;
  Reduce/prevent transcription of nucleic acid encoding MFAP4, GRHPR, ITFG1, ABCC4, PAK3, TRNP1, APLN, KIF20A, and/or LTB;
  Increase degradation of RNA (e.g. mRNA) encoding MFAP4, GRHPR, ITFG1, ABCC4, PAK3, TRNP1, APLN, KIF20A, and/or LTB;
  Reduce the level of MFAP4, GRHPR, ITFG1, ABCC4, PAK3, TRNP1, APLN, KIF20A, and/or LTB protein;
  Reduce/prevent post-transcriptional processing (e.g. splicing, translation, post-translational processing) of RNA encoding MFAP4, GRHPR, ITFG1, ABCC4, PAK3, TRNP1, APLN, KIF20A, and/or LTB;

Promote/increase degradation of MFAP4, GRHPR, ITFG1, ABCC4, PAK3, TRNP1, APLN, KIF20A, and/or LTB protein;

Reduce/prevent the level of a MFAP4, GRHPR, ITFG1, ABCC4, PAK3, TRNP1, APLN, KIF20A, and/or LTB function; and/or Reduce/prevent interaction between MFAP4, GRHPR, ITFG1, ABCC4, PAK3, TRNP1, APLN, KIF20A, and/or LTB and an interaction partner for MFAP4, GRHPR, ITFG1, ABCC4, PAK3, TRNP1, APLN, KIF20A, and/or LTB.

Gene expression can be determined by means well known to the skilled person. The level of RNA encoding one or more of the target proteins can be determined e.g. by techniques such as RT-qPCR, northern blot, etc. By way of illustration, qRT-PCR may be used to determine the level of RNA encoding a target protein.

A reduction in the level of RNA encoding a target protein may e.g. be the result of reduced transcription of nucleic acid encoding the target protein, or increased degradation of RNA encoding the target protein.

Reduced transcription of nucleic acid encoding a target protein may be a consequence of inhibition of assembly and/or activity of factors required for transcription of the DNA encoding the target protein. Increased degradation of RNA encoding a target protein may be a consequence of increased enzymatic degradation of RNA encoding the target protein, e.g. as a consequence of RNA interference (RNAi), and/or reduced stability of RNA encoding the target protein.

Protein expression can be determined by means well known to the skilled person. The level of protein encoding a target protein can be determined e.g. by antibody-based methods including western blot, immunohisto/cytochemistry, flow cytometry, ELISA, ELISPOT, or by reporter-based methods.

A reduction in the level of a target protein may e.g. be the result of reduced level of RNA encoding the target protein, reduced post-transcriptional processing of RNA encoding the target protein, or increased degradation of the target protein.

Reduced post-transcriptional processing of a target protein may be e.g. reduced splicing of pre-mRNA encoding the target protein to mature mRNA encoding the target protein, reduced translation of mRNA encoding the target protein, or reduced post-translational processing of the target protein.

Reduced splicing of pre-mRNA encoding the target protein to mature mRNA encoding the target protein may be a consequence of inhibition of assembly and/or activity of factors required for splicing. Reduced translation of mRNA encoding the target protein may be a consequence of inhibition of assembly and/or activity of factors required for translation. Reduced post-translational processing (e.g. enzymatic processing, folding) of the target protein may be a consequence of inhibition of assembly and/or activity of factors required for post-translational processing of the target protein. Increased degradation of the target protein may be a consequence of increased enzymatic (e.g. protease-mediated) degradation of the target protein.

In some embodiments, inhibition of a target gene/protein may be characterised by a reduced level of a function of the target protein. A function of the target protein may be any functional property of the target protein.

An interaction partner may be any nucleic acid or protein which interacts with, or jointly contributes to a shared function with, any one or more of MFAP4, GRHPR, ITFG1, ABCC4, PAK3, TRNP1, APLN, KIF20A, and/or LTB.

In some embodiments, an interaction partner for MFAP4 is integrin αvβ3, tropoelastin, fibrillin-1, fibrillin-2, desmosine, LOX, MFAP2, FBLN1, FBLN2, MFAP5, EFEMP2, EFEMP1, SFTPD, or elastin.

In some embodiments, an interaction partner for GRHPR is glyoxylate, hydroxypyruvate, D-glycerate, AGXT, HYI, GLYCTK, PGP, GLO1, HAO1, HAO2, DAO, NADPH or NADH.

In some embodiments, an interaction partner for ITFG1 is RUVBL1, RUVBL2, alpha-tubulin, TIPIN, ATP9A, ASCC2, RFX7, or TM7SF3.

In some embodiments, an interaction partner for ABCC4 is ATP, ABCG4, SNX27, ABCA3, ABCE1, MRPS7, SLC22A8, SLCO1B1, NR1H4 or SLC22A6.

In some embodiments, an interaction partner for PAK3 is PAK1, CDC42, NCK1, MAPK14, RAC1, PXN, GIT1, GIT2, ARHGEF7 or ARHGEF6.

In some embodiments, an interaction partner for TRNP1 is TMF1, FAM18A, CNIH3, SMARCC2, FAM19A3, TBC1D3A, TBC13D, ARHGAP11B, or GPR56.

In some embodiments, an interaction partner for APLN is APLNR, AGTR1, AGT, CXCR4, CCR5, KNG1, NPY, PDYN, NMU, or POMC.

In some embodiments, an interaction partner for KIF20A is MAD2L1, AURKB, RACGAP1, KIF11, PLK1, CDCA8, KIF4A, CENPE, PRC1, or INCENP.

In some embodiments, an interaction partner for LTB is LTBR, LTA, TNF, TNFSF14, TNFRSF1B, TNFSF13B, TNFRSF11A, CD40LG, MAP3K14, TNFSF11.

Functional properties of MFAP4, GRHPR, ITFG1, ABCC4, PAK3, TRNP1, APLN, KIF20A, and/or LTB can be analysed using appropriate assays, e.g. in vitro assays.

In some embodiments, MFAP4 inhibition increases expression and/or activation of one or more of Ptgs2, Areg, Dhrs9, Hmox1, Nqo1, P70S6k, p38, mTOR, and/or ERK2. In some embodiments, an inhibitor of MFAP4 activates mTOR, p70S6K, ERK and p38 signalling pathways.

Inhibition of interaction between a target protein and an interaction partner for the target protein can be identified e.g. by detection of a reduction in the level of interaction between the target protein and the interaction partner, relative to a control, uninhibited condition. The ability of proteins to interact can be analysed by methods well known to the skilled person, such as co-immunoprecipitation, and resonance energy transfer (RET) assays.

Inhibition of target protein function can also be evaluated by analysis of one or more correlates of target protein function. That is, target protein function can be evaluated by analysis of downstream functional consequences of target protein function. For example, inhibition of target protein function can be identified by detection of reduced expression (gene and/or protein expression) and/or activity of one or more proteins whose expression is directly/indirectly upregulated as a consequence of target protein function. Inhibition of target protein function can also be identified by detection of increased expression (gene and/or protein expression) and/or activity of one or more proteins whose expression is directly/indirectly downregulated as a consequence of target protein function.

Inhibitors

Provided herein are inhibitors that target one or more genes/proteins from the group selected from: MFAP4, GRHPR, ITFG1, ABCC4, PAK3, TRNP1, APLN, KIF20A, and LTB.

An "inhibitor of MFAP4, GRHPR, ITFG1, ABCC4, PAK3, TRNP1, APLN, KIF20A, and/or LTB" refers to any agent capable of inhibiting any one or more of MFAP4, GRHPR, ITFG1, ABCC4, PAK3, TRNP1, APLN, KIF20A, and/or LTB expression and/or function. Such agents may be effectors of (i.e. may directly or indirectly cause) inhibition of any one or more of MFAP4, GRHPR, ITFG1, ABCC4, PAK3, TRNP1, APLN, KIF20A, and/or LTB as described hereinabove.

Agents capable of inhibiting any one or more of MFAP4, GRHPR, ITFG1, ABCC4, PAK3, TRNP1, APLN, KIF20A, and/or LTB may be referred to herein as MFAP4, GRHPR, ITFG1, ABCC4, PAK3, TRNP1, APLN, KIF20A, and/or LTB inhibitors. MFAP4, GRHPR, ITFG1, ABCC4, PAK3, TRNP1, APLN, KIF20A, and/or LTB inhibitors may also be referred to herein as antagonists of MFAP4, GRHPR, ITFG1, ABCC4, PAK3, TRNP1, APLN, KIF20A, and/or LTB, or MFAP4, GRHPR, ITFG1, ABCC4, PAK3, TRNP1, APLN, KIF20A, and/or LTB antagonists.

"An inhibitor" of MFAP4, GRHPR, ITFG1, ABCC4, PAK3, TRNP1, APLN, KIF20A, and/or LTB may refer to any agent capable of inhibiting any one of MFAP4, GRHPR, ITFG1, ABCC4, PAK3, TRNP1, APLN, KIF20A, or LTB. In addition, "An inhibitor of MFAP4, GRHPR, ITFG1, ABCC4, PAK3, TRNP1, APLN, KIF20A, and/or LTB" may refer to two or more agents capable of inhibiting two, three, four, five, six, seven, eight, or nine target genes/proteins selected from the group consisting of MFAP4, GRHPR, ITFG1, ABCC4, PAK3, TRNP1, APLN, KIF20A, and LTB. Multiple inhibitors may be used in the methods of the present disclosure to target two or more of the target genes/proteins.

In some embodiments, an inhibitor of MFAP4, GRHPR, ITFG1, ABCC4, PAK3, TRNP1, APLN, KIF20A, and/or LTB (i.e. a target protein) may:

Reduce/prevent expression (e.g. gene and/or protein expression) of MFAP4, GRHPR, ITFG1, ABCC4, PAK3, TRNP1, APLN, KIF20A, and/or LTB;

Reduce the level of RNA encoding MFAP4, GRHPR, ITFG1, ABCC4, PAK3, TRNP1, APLN, KIF20A, and/or LTB;

Reduce/prevent transcription of nucleic acid encoding MFAP4, GRHPR, ITFG1, ABCC4, PAK3, TRNP1, APLN, KIF20A, and/or LTB;

Increase degradation of RNA (e.g. mRNA) encoding MFAP4, GRHPR, ITFG1, ABCC4, PAK3, TRNP1, APLN, KIF20A, and/or LTB;

Reduce the level of MFAP4, GRHPR, ITFG1, ABCC4, PAK3, TRNP1, APLN, KIF20A, and/or LTB protein;

Reduce/prevent post-transcriptional processing (e.g. splicing, translation, post-translational processing) of RNA encoding MFAP4, GRHPR, ITFG1, ABCC4, PAK3, TRNP1, APLN, KIF20A, and/or LTB;

Promote/increase degradation of MFAP4, GRHPR, ITFG1, ABCC4, PAK3, TRNP1, APLN, KIF20A, and/or LTB protein;

Reduce/prevent the level of a MFAP4, GRHPR, ITFG1, ABCC4, PAK3, TRNP1, APLN, KIF20A, and/or LTB function; and/or Reduce/prevent interaction between MFAP4, GRHPR, ITFG1, ABCC4, PAK3, TRNP1, APLN, KIF20A, and/or LTB and an interaction partner for MFAP4, GRHPR, ITFG1, ABCC4, PAK3, TRNP1, APLN, KIF20A, and/or LTB.

It will be appreciated that a given inhibitor may display more than one of the properties recited in the preceding paragraph. A given inhibitor may be evaluated for the properties recited in the preceding paragraph using suitable assays. The assays may be e.g. in vitro assays, optionally cell-based assays or cell-free assays. The assays may be e.g. in vivo assays, i.e. performed in non-human animals.

Where assays are cell-based assays, they may comprise treating cells with an inhibitor (e.g. a nucleic acid) in order to determine whether the inhibitor displays one or more of the recited properties. Assays may employ species labelled with detectable entities in order to facilitate their detection. Assays may comprise evaluating the recited properties following treatment of cells separately with a range of quantities/concentrations of a given inhibitor (e.g. a dilution series). It will be appreciated that the cells are preferably cells that express the target protein to be inhibited, e.g. liver cells (e.g. HepG2 cells or HuH7 cells).

Analysis of the results of such assays may comprise determining the concentration at which 50% of the maximal level of the relevant activity is attained. The concentration of nucleic acid at which 50% of the maximal level of the relevant activity is attained may be referred to as the 'half-maximal effective concentration' of the inhibitor in relation to the relevant activity, which may also be referred to as the '$EC_{50}$'. By way of illustration, the $EC_{50}$ of a given inhibitor (e.g. inhibitory nucleic acid) for increasing degradation of RNA encoding a target protein may be the concentration at which 50% of the maximal level of degradation of RNA encoding a target protein is achieved.

Depending on the property, the $EC_{50}$ may also be referred to as the 'half-maximal inhibitory concentration' or '$IC_{50}$', this being the concentration of inhibitor at which 50% of the maximal level of inhibition of a given property is observed. By way of illustration, the $IC_{50}$ of a given inhibitor (e.g. inhibitory nucleic acid) for reducing expression of a gene encoding a target protein may be the concentration at which 50% of the maximal level of inhibition of expression of the gene is achieved.

Agents capable of reducing/preventing gene expression of any one or more MFAP4, GRHPR, ITFG1, ABCC4, PAK3, TRNP1, APLN, KIF20A, and/or LTB (e.g. reducing the level of RNA encoding MFAP4, GRHPR, ITFG1, ABCC4, PAK3, TRNP1, APLN, KIF20A, and/or LTB; reducing/preventing transcription of nucleic acid encoding MFAP4, GRHPR, ITFG1, ABCC4, PAK3, TRNP1, APLN, KIF20A, and/or LTB; and/or increasing degradation of RNA encoding MFAP4, GRHPR, ITFG1, ABCC4, PAK3, TRNP1, APLN, KIF20A, and/or LTB) may be identified using assays comprising detecting the level of RNA encoding the target protein, e.g. by RT-qPCR (a technique well known to the skilled person). The methods may employ primers and/or probes for the detection and/or quantification of RNA encoding MFAP4, GRHPR, ITFG1, ABCC4, PAK3, TRNP1, APLN, KIF20A, and/or LTB.

Such assays may comprise introducing (e.g. by transfection) into cells that express the target protein in in vitro culture (i) a putative inhibitor (e.g. an inhibitory nucleic acid), or (ii) a control agent (e.g. a control nucleic acid, such as a nucleic acid known not to influence the level of RNA encoding the target protein), and subsequently (e.g. after an appropriate period of time, i.e. a period of time sufficient for a reduction in the level of gene expression of the target protein/transcription of nucleic acid encoding the target protein/level of RNA encoding the target protein or an increase in the level of degradation of RNA encoding the target protein to be observed) measuring the level of RNA encoding the target protein in cells according to (i) and (ii), and (iii) comparing the level of RNA encoding the target protein detected to determine whether the putative inhibitor reduces/prevents gene expression of the target protein, reduces/prevents transcription of nucleic acid encoding the target protein, reduces the level of RNA encoding the target protein, and/or increases degradation of RNA encoding the target protein.

Agents capable of reducing protein expression of any one or more MFAP4, GRHPR, ITFG1, ABCC4, PAK3, TRNP1, APLN, KIF20A, and/or LTB (e.g. reducing the level of MFAP4, GRHPR, ITFG1, ABCC4, PAK3, TRNP1, APLN, KIF20A, and/or LTB protein, increasing degradation of MFAP4, GRHPR, ITFG1, ABCC4, PAK3, TRNP1, APLN, KIF20A, and/or LTB protein) may be identified using assays comprising detecting the level of the target protein, e.g. using antibody/reporter-based methods (western blot, ELISA, immunohisto/cytochemistry, etc.). Such assays may comprise treating cells/tissue with the agent, and subsequently comparing the level of the target protein in such cells/tissue to the level of the target protein in cells/tissue of an appropriate control condition (e.g. untreated/vehicle-treated cells/tissue).

The methods may employ antibodies specific for the target protein. Such assays may comprise introducing (e.g. by transfection) into cells that express a target protein in in vitro culture (i) a putative inhibitor (e.g. an inhibitory nucleic acid), or (ii) a control agent (e.g. a nucleic acid known not to influence the level of the target protein), and subsequently (e.g. after an appropriate period of time, i.e. a period of time sufficient for a reduction in the level of the target protein to be observed) measuring the level of the target protein in cells according to (i) and (ii), and (iii) comparing the level of the target protein detected to determine whether the putative inhibitor reduces the level of the target protein and/or reduces/prevents translation of mRNA encoding the target protein.

Agents capable of reducing the level of a function of any one or more MFAP4, GRHPR, ITFG1, ABCC4, PAK3, TRNP1, APLN, KIF20A, and/or LTB (e.g. a function of a target protein as described herein) may be identified using assays comprising detecting the level of the relevant function. Such assays may comprise introducing (e.g. by transfection) into cells that express the target protein in in vitro culture (i) a putative inhibitor (e.g. an inhibitory nucleic acid), or (ii) a control agent (e.g. a nucleic acid known not to influence target protein function), and subsequently (e.g. after an appropriate period of time, i.e. a period of time sufficient for a reduction in the level of a function of the target protein to be observed) measuring the level of a function of the target protein in cells according to (i) and (ii), and (iii) comparing the level of the function of the target protein detected to determine whether the putative inhibitor reduces the level of a function of the target protein.

Reference herein to 'a function of the target protein' may refer to any functional property of, and/or activity mediated by, MFAP4, GRHPR, ITFG1, ABCC4, PAK3, TRNP1, APLN, KIF20A, and/or LTB protein.

Agents capable of reducing/preventing normal splicing of pre-mRNA encoding any one or more of MFAP4, GRHPR, ITFG1, ABCC4, PAK3, TRNP1, APLN, KIF20A, and/or LTB may be identified using assays comprising detecting and/or quantifying the level of RNA (e.g. mature mRNA) encoding one or more isoforms of MFAP4, GRHPR, ITFG1, ABCC4, PAK3, TRNP1, APLN, KIF20A, and/or LTB. Such assays may comprise quantifying RNA (e.g. mature mRNA) encoding one or more isoforms of MFAP4, GRHPR, ITFG1, ABCC4, PAK3, TRNP1, APLN, KIF20A, and/or LTB by RT-qPCR. The methods may employ primers and/or probes for the detection and/or quantification of mature mRNA produced by canonical splicing of pre-mRNA transcribed from a gene encoding MFAP4, GRHPR, ITFG1, ABCC4, PAK3, TRNP1, APLN, KIF20A, and/or LTB, and/or primers and/or probes for the detection and/or quantification of mature mRNA produced by alternative splicing of pre-mRNA transcribed from a gene encoding MFAP4, GRHPR, ITFG1, ABCC4, PAK3, TRNP1, APLN, KIF20A, and/or LTB.

Mature mRNA produced by canonical splicing of pre-mRNA transcribed from a gene encoding MFAP4, GRHPR, ITFG1, ABCC4, PAK3, TRNP1, APLN, KIF20A, and/or LTB may be mature mRNA encoding the major isoform produced by expression of the gene encoding MFAP4, GRHPR, ITFG1, ABCC4, PAK3, TRNP1, APLN, KIF20A, and/or LTB. The major isoform may be the most commonly produced/detected isoform. For example, mature mRNA produced by canonical splicing of pre-mRNA transcribed from human MFAP4 may be mature mRNA encoding human MFAP4 isoform 1 (i.e. having the amino acid sequence shown in SEQ ID NO: 7156). Mature mRNA produced by alternative splicing of pre-mRNA transcribed from a gene encoding MFAP4, GRHPR, ITFG1, ABCC4, PAK3, TRNP1, APLN, KIF20A, and/or LTB may be mature mRNA encoding an isoform other than the major isoform produced by expression of said gene. For example, mature mRNA produced by alternative splicing of pre-mRNA transcribed from human MFAP4 may be mature mRNA encoding an isoform of human MFAP4 other than isoform 1 (i.e. having an amino acid sequence non-identical to SEQ ID NO: 7156); e.g. mature mRNA encoding human MFAP4 isoform 2 (i.e. having an amino acid sequence shown in SEQ ID NO: 7157).

Such assays may comprise introducing (e.g. by transfection) into cells that express MFAP4, GRHPR, ITFG1, ABCC4, PAK3, TRNP1, APLN, KIF20A, and/or LTB in in vitro culture (i) a putative inhibitor (e.g. an inhibitory nucleic acid), or (ii) a control agent (e.g. a nucleic acid known not to influence splicing of pre-mRNA encoding the target gene), and subsequently (e.g. after an appropriate period of time, i.e. a period of time sufficient for an effect on splicing of pre-mRNA encoding the target gene to be observed) measuring the level of mature mRNA encoding one or more isoforms of the target gene in cells according to (i) and (ii), and (iii) comparing the level of mature mRNA encoding the isoform(s) to determine whether the putative inhibitor reduces/prevents normal splicing of pre-mRNA encoding the target gene.

Agents capable of reducing interaction between a target protein described herein and an interaction partner for said target protein may be identified using assays comprising detecting the level of interaction between the target protein and its interaction partner, e.g. using antibody/reporter-based methods. The level of interaction between the target protein and its interaction partner can be analysed e.g. using resonance energy transfer techniques (e.g. FRET, BRET), or methods analysing a correlate of interaction between the target protein and its interaction partner. Assays may comprise treating cells/tissue with the agent, and subsequently comparing the level of interaction between the target protein and its interaction partner in such cells/tissue to the level of interaction between the target protein and its interaction partner in cells/tissue of an appropriate control condition (e.g. untreated/vehicle-treated cells/tissue). The level of interaction between the target protein and its interaction partner can also be analysed e.g. using techniques such as ELISA, surface plasmon resonance or biolayer interferometry analysis. Assays may comprise comparing the level of interaction between the target protein and its interaction partner in the presence of the agent to the level of interaction between the target protein and its interaction partner in an appropriate control condition (e.g. the absence of the agent).

In some embodiments, an inhibitor according to the present disclosure may be capable of reducing expression of a gene encoding any one or more of MFAP4, GRHPR, ITFG1, ABCC4, PAK3, TRNP1, APLN, KIF20A, and/or LTB to less than 1 times, e.g. one of ≤0.99 times, ≤0.95 times, ≤0.9 times, ≤0.85 times, ≤0.8 times, 50.75 times, 50.7 times, 50.65 times, 50.6 times, 50.55 times, 50.5 times, 50.45 times, 50.4 times, 50.35 times, 50.3 times, 50.25 times, 50.2 times, 50.15 times, 50.1 times, 50.05 times, or ≤0.01 times the level of expression observed in the absence of the inhibitor, or in the presence of the same quantity of a control agent known not to inhibit expression of the relevant gene, in a given assay. In some embodiments, an inhibitor according to the present disclosure may be capable of reducing expression of a gene encoding any one or more of MFAP4, GRHPR, ITFG1, ABCC4, PAK3, TRNP1, APLN, KIF20A, and/or LTB to less than 100%, e.g. one of ≤99%, ≤95%, ≤90%, ≤85%, ≤80%, ≤75%, ≤70%, ≤65%, ≤60%, ≤55%, ≤50%, ≤45%, 540%, 535%, 530%, 525%, 520%, 515%, 510%, 55%, or ≤1% of the level of expression observed in the absence of the inhibitor, or in the presence of the same quantity of a control agent known not to inhibit expression of the relevant gene, in a given assay.

In some embodiments, an inhibitor according to the present disclosure may be capable of reducing the level of RNA encoding any one or more of MFAP4, GRHPR, ITFG1, ABCC4, PAK3, TRNP1, APLN, KIF20A, and/or LTB to less than 1 times, e.g. one of 50.99 times, 50.95 times, 50.9 times, 50.85 times, 50.8 times, 50.75 times, 50.7 times, 50.65 times, 50.6 times, 50.55 times, 50.5 times, 50.45 times, 50.4 times, 50.35 times, 50.3 times, 50.25 times, 50.2 times, 50.15 times, 50.1 times, 50.05 times, or ≤0.01 times the level observed in the absence of the inhibitor, or in the presence of the same quantity of a control agent known not to reduce the level of RNA encoding MFAP4, GRHPR, ITFG1, ABCC4, PAK3, TRNP1, APLN, KIF20A, and/or LTB, in a given assay. In some embodiments, an inhibitor according to the present disclosure may be capable of reducing the level of RNA encoding any one or more of MFAP4, GRHPR, ITFG1, ABCC4, PAK3, TRNP1, APLN, KIF20A, and/or LTB to less than 100%, e.g. one of 599%, 595%, 590%, 585%, ≤80%, ≤75%, ≤70%, ≤65%, ≤60%, ≤55%, ≤50%, ≤45%, ≤40%, ≤35%, ≤30%, ≤25%, ≤20%, ≤15%, ≤10%, 55%, or ≤1% of the level observed in the absence of the inhibitor, or in the presence of the same quantity of a control agent known not to reduce the level of RNA encoding MFAP4, GRHPR, ITFG1, ABCC4, PAK3, TRNP1, APLN, KIF20A, and/or LTB, in a given assay.

In some embodiments, an inhibitor according to the present disclosure may be capable of reducing the level of transcription of nucleic acid encoding any one or more of MFAP4, GRHPR, ITFG1, ABCC4, PAK3, TRNP1, APLN, KIF20A, and/or LTB to less than 1 times, e.g. one of ≤0.99 times, 50.95 times, 50.9 times, 50.85 times, 50.8 times, 50.75 times, 50.7 times, 50.65 times, 50.6 times, 50.55 times, 50.5 times, 50.45 times, 50.4 times, 50.35 times, 50.3 times, 50.25 times, 50.2 times, 50.15 times, 50.1 times, 50.05 times, or ≤0.01 times the level observed in the absence of the inhibitor, or in the presence of the same quantity of a control agent known not to reduce transcription of nucleic acid encoding MFAP4, GRHPR, ITFG1, ABCC4, PAK3, TRNP1, APLN, KIF20A, and/or LTB, in a given assay. In some embodiments, an inhibitor according to the present disclosure may be capable of reducing the level of transcription of nucleic acid encoding any one or more of MFAP4, GRHPR, ITFG1, ABCC4, PAK3, TRNP1, APLN, KIF20A, and/or LTB to less than 100%, e.g. one of ≤99%, ≤95%, ≤90%, ≤85%, ≤80%, ≤75%, ≤70%, ≤65%, ≤60%, ≤55%, ≤50%, 545%, 540%, 535%, 530%, 525%, 520%, 515%, 510%, 55%, or ≤1% of the level observed in the absence of the inhibitor, or in the presence of the same quantity of a control agent known not to reduce transcription of nucleic acid encoding MFAP4, GRHPR, ITFG1, ABCC4, PAK3, TRNP1, APLN, KIF20A, and/or LTB, in a given assay.

In some embodiments, an inhibitor according to the present disclosure may be capable of reducing the level of any one or more of MFAP4, GRHPR, ITFG1, ABCC4, PAK3, TRNP1, APLN, KIF20A, and/or LTB protein to less than 1 times, e.g. one of ≤0.99 times, 50.95 times, 50.9 times, 50.85 times, 50.8 times, 50.75 times, 50.7 times, 50.65 times, 50.6 times, 50.55 times, 50.5 times, 50.45 times, 50.4 times, 50.35 times, 50.3 times, 50.25 times, 50.2 times, 50.15 times, 50.1 times, 50.05 times, or ≤0.01 times the level observed in the absence of the inhibitor, or in the presence of the same quantity of a control agent known not to reduce the level of MFAP4, GRHPR, ITFG1, ABCC4, PAK3, TRNP1, APLN, KIF20A, and/or LTB protein, in a given assay. In some embodiments, an inhibitor according to the present disclosure may be capable of reducing the level of any one or more of MFAP4, GRHPR, ITFG1, ABCC4, PAK3, TRNP1, APLN, KIF20A, and/or LTB protein to less than 100%, e.g. one of ≤99%, ≤95%, ≤90%, ≤85%, ≤80%, ≤75%, ≤70%, ≤65%, ≤60%, ≤55%, ≤50%, ≤45%, ≤40%, ≤35%, ≤30%, ≤25%, ≤20%, ≤15%, ≤10%, ≤5%, or ≤1% of the level observed in the absence of the inhibitor, or in the presence of the same quantity of a control agent known not to reduce the level of MFAP4, GRHPR, ITFG1, ABCC4, PAK3, TRNP1, APLN, KIF20A, and/or LTB protein, in a given assay.

In some embodiments, an inhibitor according to the present disclosure may be capable of reducing the level of a function of any one or more of MFAP4, GRHPR, ITFG1, ABCC4, PAK3, TRNP1, APLN, KIF20A, and/or LTB to less than 1 times, e.g. one of 50.99 times, 50.95 times, 50.9 times, 50.85 times, 50.8 times, 50.75 times, 50.7 times, 50.65 times, 50.6 times, 50.55 times, 50.5 times, 50.45 times, 50.4 times, 50.35 times, 50.3 times, 50.25 times, 50.2 times, 50.15 times, 50.1 times, 50.05 times, or ≤0.01 times the level observed in the absence of the inhibitor, or in the presence of the same quantity of a control agent known not to reduce the level of the function of MFAP4, GRHPR, ITFG1, ABCC4, PAK3, TRNP1, APLN, KIF20A, and/or LTB, in a given assay. In some embodiments, an inhibitor according to the present disclosure may be capable of reducing the level of a function of any one or more of MFAP4, GRHPR, ITFG1, ABCC4, PAK3, TRNP1, APLN, KIF20A, and/or LTB to less than 100%, e.g. one of 599%, 595%, 590%, 585%, ≤80%, ≤75%, ≤70%, ≤65%, ≤60%, ≤55%, ≤50%, ≤45%, ≤40%, ≤35%, ≤30%, ≤25%, ≤20%, ≤15%, ≤10%, 55%, or ≤1% of the level observed in the absence of the inhibitor, or in the presence of the same quantity of a control agent known not to reduce the level of the function of MFAP4, GRHPR, ITFG1, ABCC4, PAK3, TRNP1, APLN, KIF20A, and/or LTB, in a given assay.

In some embodiments, an inhibitor according to the present disclosure may be capable of reducing the level of binding of any one or more of MFAP4, GRHPR, ITFG1, ABCC4, PAK3, TRNP1, APLN, KIF20A, and/or LTB to an interaction partner to less than 1 times, e.g. one of 50.99 times, 50.95 times, 50.9 times, 50.85 times, 50.8 times, 50.75 times, 50.7 times, 50.65 times, 50.6 times, 50.55 times, 50.5 times, 50.45 times, 50.4 times, 50.35 times, 50.3 times, 50.25 times, 50.2 times, 50.15 times, 50.1 times, 50.05 times, or ≤0.01 times the level observed in the absence of the inhibitor, or in the presence of the same quantity of a control agent known not to reduce the level of binding, in a given assay. In some embodiments, an inhibitor according to the present disclosure may be capable of reducing the level of binding of any one or more of MFAP4, GRHPR, ITFG1, ABCC4, PAK3, TRNP1, APLN, KIF20A, and/or LTB to an interaction partner to less than 100%, e.g. one of ≤99%, ≤95%, ≤90%, ≤85%, ≤80%, ≤75%, ≤70%, ≤65%, ≤60%, ≤55%, ≤50%, 545%, 540%, 535%, 530%, 525%, 520%, 515%, 510%, 55%, or ≤1% of the level observed in the absence of the inhibitor, or in the presence of the same quantity of a control agent known not to reduce the level of the relevant binding, in a given assay.

In some embodiments, an inhibitor according to the present disclosure may be capable of reducing normal splicing of pre-mRNA encoding any one or more of MFAP4, GRHPR, ITFG1, ABCC4, PAK3, TRNP1, APLN, KIF20A, and/or LTB to less than 1 times, e.g. one of 50.99 times, 50.95 times, 50.9 times, 50.85 times, 50.8 times, 50.75 times, 50.7 times, 50.65 times, 50.6 times, 50.55 times, 50.5 times, 50.45 times, 50.4 times, 50.35 times, 50.3 times, 50.25 times, 50.2 times, 50.15 times, 50.1 times, 50.05 times, or ≤0.01 times the level observed in the absence of the inhibitor, or in the presence of the same quantity of a control agent known not to reduce normal splicing of pre-mRNA encoding the relevant target protein(s), in a given assay. In some embodiments, an inhibitor according to the present disclosure may be capable of reducing the level of normal splicing of pre-mRNA encoding any one or more of MFAP4, GRHPR, ITFG1, ABCC4, PAK3, TRNP1, APLN, KIF20A, and/or LTB to less than 100%, e.g. one of 599%, 595%, 590%, 585%, ≤80%, ≤75%, ≤70%, ≤65%, ≤60%, ≤55%, ≤50%, ≤45%, ≤40%, ≤35%, ≤30%, ≤25%, ≤20%, ≤15%, ≤10%, 55%, or ≤1% of the level observed in the absence of the inhibitor, or in the presence of the same quantity of a control agent known not to reduce normal splicing of pre-mRNA encoding the relevant target protein(s), in a given assay.

In some embodiments, an inhibitor according to the present disclosure may be capable of reducing translation of mRNA encoding any one or more of MFAP4, GRHPR, ITFG1, ABCC4, PAK3, TRNP1, APLN, KIF20A, and/or LTB to less than 1 times, e.g. one of ≤0.99 times, ≤0.95 times, ≤0.9 times, ≤0.85 times, ≤0.8 times, 50.75 times, 50.7 times, 50.65 times, 50.6 times, 50.55 times, 50.5 times, 50.45 times, 50.4 times, 50.35 times, 50.3 times, 50.25 times, 50.2 times, 50.15 times, 50.1 times, 50.05 times, or ≤0.01 times the level observed in the absence of the inhibitor, or in the presence of the same quantity of a control agent known not to reduce translation of mRNA encoding the relevant target protein(s), in a given assay. In some embodiments, an inhibitor according to the present disclosure may be capable of reducing translation of mRNA encoding any one or more of MFAP4, GRHPR, ITFG1, ABCC4, PAK3, TRNP1, APLN, KIF20A, and/or LTB to less than 100%, e.g. one of 599%, 595%, 590%, 585%, 580%, 575%, 570%, 565%, 560%, ≤55%, ≤50%, ≤45%, ≤40%, ≤35%, ≤30%, ≤25%, ≤20%, ≤15%, ≤10%, ≤5%, or ≤1% of the level observed in the absence of the inhibitor, or in the presence of the same quantity of a control agent known not to reduce translation of mRNA encoding the relevant target protein(s), in a given assay.

Preferred levels of reduction in accordance with the preceding eight paragraphs are reduction to less than 0.5 times/550%, e.g. one of less than 0.4 times/540%, less than 0.3 times/530%, less than 0.2 times/≤20%, less than 0.15 times/≤15%, or less than 0.1 times/≤10%.

In some embodiments, an inhibitor according to the present disclosure may be capable of increasing degradation of RNA encoding any one or more of MFAP4, GRHPR, ITFG1, ABCC4, PAK3, TRNP1, APLN, KIF20A, and/or LTB to more than 1 times, e.g. one of ≥1.01 times, ≥1.02 times, ≥1.03 times, ≥1.04 times, ≥1.05 times, ≥1.1 times, ≥1.2 times, ≥1.3 times, ≥1.4 times, ≥1.5 times, ≥1.6 times, ≥1.7 times, ≥1.8 times, ≥1.9 times, ≥2 times, ≥3 times, ≥4 times, ≥5 times, ≥6 times, ≥7 times, ≥8 times, ≥9 times or ≥10 times the level observed in the absence of the inhibitor, or in the presence of the same quantity of a control agent known not to increase degradation of RNA encoding the relevant target protein(s), in a given assay.

In some embodiments, an inhibitor according to the present disclosure prevents or silences expression of a gene encoding any one or more of MFAP4, GRHPR, ITFG1, ABCC4, PAK3, TRNP1, APLN, KIF20A, and/or LTB. In some embodiments, an inhibitor according to the present disclosure prevents or silences expression of any one or more of MFAP4, GRHPR, ITFG1, ABCC4, PAK3, TRNP1, APLN, KIF20A, and/or LTB at the protein level. As used herein, expression of a given gene/protein may be considered to be 'prevented' or 'silenced' where the level of expression is reduced to less than 0.1 times/≤10% of the level observed in the absence of the inhibitor, or in the presence of the same quantity of a control agent known not to be an inhibitor of expression of the relevant gene(s)/protein(s).

In preferred embodiments, an inhibitor (e.g. an inhibitory nucleic acid, such as an siRNA or shRNA) according to the present disclosure inhibits greater than 50%, e.g. one of 260%, ≥61%, ≥62%, ≥63%, ≥64%, ≥65%, ≥66%, ≥67%, ≥68%, ≥69%, ≥70%, ≥71%, ≥72%, ≥73%, ≥74%, ≥75%, ≥76%, ≥77%, ≥78%, ≥79%, ≥80%, ≥81%, ≥82%, ≥83%, ≥84%, ≥85%, ≥86%, ≥87%, ≥88%, ≥89%, ≥90%, ≥91%, ≥92%, ≥93%, ≥94%, ≥95%, ≥96%, ≥97%, ≥98%, ≥99% or 100% of the gene and/or protein expression of any one or more of MFAP4, GRHPR, ITFG1, ABCC4, PAK3, TRNP1, APLN, KIF20A, and/or LTB observed in the absence of the inhibitor, or in the presence of the same quantity of a control agent known not to inhibit gene and/or protein expression of the relevant gene(s)/protein(s), in a given assay.

In preferred embodiments, an inhibitor (e.g. an inhibitory nucleic acid, such as an siRNA or shRNA) according to the present disclosure inhibits greater than 50%, e.g. one of 260%, ≥61%, ≥62%, ≥63%, ≥64%, 65%, ≥66%, ≥67%, ≥68%, ≥69%, ≥70%, ≥71%, ≥72%, ≥73%, ≥74%, ≥75%, ≥76%, ≥77%, ≥78%, ≥79%, 80%, ≥81%, ≥82%, ≥83%, ≥84%, ≥85%, ≥86%, ≥87%, ≥88%, ≥89%, ≥90%, ≥91%, ≥92%, ≥93%, ≥94%, ≥95%, ≥96%, ≥97%, ≥98%, ≥99% or 100% of the gene expression of any one or more of MFAP4, GRHPR, ITFG1, ABCC4, PAK3, TRNP1, APLN, KIF20A, and/or LTB (e.g. as determined by qRT-PCR) observed in the absence of the inhibitor, or in the presence of the same quantity of a control agent known not to inhibit gene and/or protein expression of the relevant gene(s)/protein(s), in a given assay.

In preferred embodiments, an inhibitor (e.g. an inhibitory nucleic acid, such as an siRNA or shRNA) according to the present disclosure inhibits greater than 50%, e.g. one of 260%, ≥61%, ≥62%, ≥63%, ≥64%, ≥65%, ≥66%, ≥67%, ≥68%, ≥69%, ≥70%, ≥71%, ≥72%, ≥73%, ≥74%, ≥75%, ≥76%, ≥77%, ≥78%, ≥79%, ≥80%, ≥81%, ≥82%, ≥83%, ≥84%, ≥85%, ≥86%, ≥87%, ≥88%, ≥89%, ≥90%, ≥91%, ≥92%, ≥93%, ≥94%, 295%, 296%, 297%, 298%, 299% or 100% of the protein expression of any one or more of MFAP4, GRHPR, ITFG1, ABCC4, PAK3, TRNP1, APLN, KIF20A, and/or LTB (e.g. as determined by ELISA) observed in the absence of the inhibitor, or in the presence of the same quantity of a control agent known not to inhibit gene and/or protein expression of the relevant gene(s)/protein(s), in a given assay.

In some embodiments, an inhibitor (e.g. an inhibitory nucleic acid, such as an siRNA or shRNA) according to the present disclosure may inhibit gene and/or protein expression of any one or more of MFAP4, GRHPR, ITFG1, ABCC4, PAK3, TRNP1, APLN, KIF20A, and/or LTB with an $IC_{50}$ of ≤1 µM, e.g. one of ≤500 nM, ≤100 nM, 575 nM, ≤50 nM, 540 nM, ≤30 nM, 520 nM, ≤15 nM, 512.5 nM, 510 nM, ≤9 nM, 58 nM, ≤7 nM, 56 nM, ≤5 nM, ≤4 nM, ≤3 nM, 52 nM, ≤1 nM, ≤900 pM, ≤800 pM, ≤700 pM, ≤600 pM, ≤500 pM, ≤400 pM, ≤300 pM, ≤200 pM, ≤100 pM, ≤50 pM, ≤40 pM, ≤30 pM, ≤20 pM, ≤10 pM or ≤1 pM.

In some embodiments an inhibitor according to the present disclosure may inhibit gene expression of any one or more of MFAP4, GRHPR, ITFG1, ABCC4, PAK3, TRNP1, APLN, KIF20A, and/or LTB (e.g. as determined by qRT-PCR) with an $IC_{50}$ of ≤1 nM, 5900 pM, ≤800 pM, ≤700 pM, ≤600 pM, ≤500 pM, ≤400 pM, 5300 pM, ≤200 pM, ≤100 pM, ≤50 pM, ≤40 pM, ≤30 pM, ≤20 pM, ≤10 pM or ≤1 pM.

In some embodiments an inhibitor according to the present disclosure may inhibit protein expression of any one or more of MFAP4, GRHPR, ITFG1, ABCC4, PAK3, TRNP1, APLN, KIF20A, and/or LTB (e.g. as determined by ELISA) with an $IC_{50}$ of ≤1 nM, 5900 pM, ≤800 pM, ≤700 pM, ≤600 pM, ≤500 pM, ≤400 pM, 5300 pM, ≤200 pM, ≤100 pM, ≤50 pM, ≤40 pM, ≤30 pM, ≤20 pM, ≤10 pM or ≤1 pM.

Types of Inhibitors

Inhibitors according to the present disclosure may be any kind of agent possessing the appropriate inhibitory activity.

The term "inhibitor" as used herein refers to an agent that decreases or inhibits at least one function or biological activity of a target molecule, such as those described herein.

An inhibitor according to the present disclosure may be a molecule that is capable of binding to any one or more of MFAP4, GRHPR, ITFG1, ABCC4, PAK3, TRNP1, APLN, KIF20A, and/or LTB mRNA or protein, a molecule that is capable of binding to an interacting partner of one or more of MFAP4, GRHPR, ITFG1, ABCC4, PAK3, TRNP1, APLN, KIF20A, and/or LTB, or a molecule capable of reducing expression of one or more of MFAP4, GRHPR, ITFG1, ABCC4, PAK3, TRNP1, APLN, KIF20A, and/or LTB.

In some embodiments an inhibitor is capable of binding to a polypeptide according to any one or more of SEQ ID NO: 7156 to 7178, or a mRNA according to any one of SEQ ID NO: 7179 to 7195.

In some embodiments an inhibitor targets, e.g. is capable of binding to, a functional domain or region of any one or more of SEQ ID NO: 7156 to 7178. In some embodiments an inhibitor targets a region comprising positions 22-255, 26-28 or 32-255 of SEQ ID NO: 7156. In some embodiments an inhibitor targets a region comprising one or more of positions 83-84, 162-164, 185-188, 217, 243, 245, 269, and 293-296 of SEQ ID NO: 7158. In some embodiments an inhibitor targets a region comprising positions 258-293 of SEQ ID NO: 7160. In some embodiments an inhibitor targets a region comprising positions 92-377, 410-633, 714-1005, 1041-1274, 445-452, or 1075-1082 of SEQ ID NO: 7161. In some embodiments an inhibitor targets a region comprising positions 70-83 or 283-534 of SEQ ID NO: 7165. In some embodiments an inhibitor targets a region comprising positions 64-507 or 611-762 of SEQ ID NO: 7175. In some embodiments an inhibitor targets a region comprising positions 1-18, 19-48, or 49-244 of SEQ ID NO: 7177.

In some embodiments an inhibitor is capable of binding to an interacting partner of one or more of MFAP4, GRHPR, ITFG1, ABCC4, PAK3, TRNP1, APLN, KIF20A, and/or LTB, such as those described hereinabove.

Such binding molecules can be identified using any suitable assay for detecting binding of a molecule to the relevant factor (i.e. a target gene/protein described herein, or an interaction partner for said protein(s)). Such assays may comprise detecting the formation of a complex between the relevant factor and the molecule.

In some embodiments, the inhibitor is a nucleic acid, peptide, antibody, antigen-binding molecule or small molecule inhibitor.

Small molecule inhibitors that bind to the target mRNA/proteins described herein, or their binding partners, can be identified by screening of small molecule libraries. As used herein, a "small molecule" refers to a low molecular weight (<1000 daltons, typically between ~300-700 daltons) organic compound. Small molecule inhibitors that bind to the target mRNA/proteins described herein can be identified e.g. using a method described in Horswill A R et al., PNAS, 2004,101 (44) 15591-15596, which is hereby incorporated by reference in its entirety.

An inhibitor of GRHPR may be 4-hydroxy-2-oxoglutarate.

An inhibitor of ABCC4 may be Methotrexate, Mercaptopurine, Zidovudine, Dipyridamole, Probenecid, Sulfinpyrazone, Fluorouraci, Rucaparib, Adefovir dipivoxil, Cefazolin, Tyrphostin AG1478, Dantrolene, Glafenine, Nalidixic Acid or Prazosin.

An inhibitor of PAK3 may be FRAX597.

An inhibitor of APLN may be ML221, an apelin receptor (APJ) antagonist.

An inhibitor of KIF20A may be BKS0349 or Paprotrain.

Inhibitors provided herein include peptides/polypeptides, e.g. peptide aptamers, thioredoxins, monobodies, anticalin, Kunitz domains, avimers, knottins, fynomers, atrimers, DARPins, affibodies, nanobodies (i.e. single-domain antibodies (sdAbs)) affilins, armadillo repeat proteins (ArmRPs), OBodies and fibronectin—reviewed e.g. in Reverdatto et al., Curr Top Med Chem. 2015; 15(12): 1082-1101, which is hereby incorporated by reference in its entirety (see also e.g. Boersma et al., J Biol Chem (2011) 286:41273-85 and Emanuel et al., Mabs (2011) 3:38-48). Inhibitors include peptides/polypeptides that can be identified by screening of libraries of the relevant peptides/polypeptides. The peptide/polypeptide inhibitors may be referred to as inhibitory peptides/polypeptides.

Inhibitory peptides/polypeptides may also include e.g. peptide/polypeptide interaction partners for the target gene/mRNA/protein of interest (i.e. MFAP4, GRHPR, ITFG1, ABCC4, PAK3, TRNP1, APLN, KIF20A, and/or LTB).

Peptide/polypeptide interaction partners may be based on an interaction partner for the target gene/mRNA/protein of interest, and may e.g. comprise a fragment of an interaction partner said target(s). Peptide/polypeptide interaction partners may be based on one or more of MFAP4, GRHPR, ITFG1, ABCC4, PAK3, TRNP1, APLN, KIF20A, and/or LTB, and may e.g. comprise a fragment of MFAP4, GRHPR, ITFG1, ABCC4, PAK3, TRNP1, APLN, KIF20A, and/or LTB that binds to an interaction partner for said mRNA/protein. Such agents may behave as 'decoy' molecules, and preferably display competitive inhibition of interaction between MFAP4, GRHPR, ITFG1, ABCC4, PAK3, TRNP1, APLN, KIF20A, and/or LTB and a corresponding interaction partner for MFAP4, GRHPR, ITFG1, ABCC4, PAK3, TRNP1, APLN, KIF20A, and/or LTB.

An inhibitor of MFAP4 may, for example, be a peptide/polypeptide that is capable of blocking the interaction between MFAP4 and an integrin receptor, integrin αvβ3, tropoelastin, fibrillin-1, fibrillin-2, desmosine, LOX, MFAP2, FBLN1, FBLN2, MFAP5, EFEMP2, EFEMP1, SFTPD, or elastin.

An inhibitor of GRHPR may, for example, be a peptide/polypeptide that is capable of blocking the interaction between GRHPR and glyoxylate, hydroxypyruvate, D-glycerate, AGXT, HYI, GLYCTK, PGP, GLO1, HAO1, HAO2, DAO, NADPH or NADH.

An inhibitor of ITFG1 may, for example, be a peptide/polypeptide that is capable of blocking the interaction between ITFG1 and RUVBL1, RUVBL2, alpha-tubulin, TIPIN, ATP9A, ASCC2, RFX7, or TM7SF3.

An inhibitor of ABCC4 may, for example, be a peptide/polypeptide that is capable of blocking the interaction between ABCC4 and ATP, ABCG4, SNX27, ABCA3, ABCE1, MRPS7, SLC22A8, SLCO1B1, NR1H4 or SLC22A6.

An inhibitor of PAK3 may, for example, be a peptide/polypeptide that is capable of blocking the interaction between PAK3 and PAK1, CDC42, NCK1, MAPK14, RAC1, PXN, GIT1, GIT2, ARHGEF7 or ARHGEF6.

An inhibitor of TRNP1 may, for example, be a peptide/polypeptide that is capable of blocking the interaction between TRNP1 and TMF1, FAM18A, CNIH3, SMARCC2, FAM19A3, TBC1D3A, TBC1D3D, ARHGAP11B, or GPR56.

An inhibitor of APLN may, for example, be a peptide/polypeptide that is capable of blocking the interaction between APLN and APLNR, AGTR1, AGT, CXCR4, CCR5, KNG1, NPY, PDYN, NMU, or POMC.

An inhibitor of KIF20A may, for example, be a peptide/polypeptide that is capable of blocking the interaction between KIF20A and MAD2L1, AURKB, RACGAP1, KIF11, PLK1, CDCA8, KIF4A, CENPE, PRC1, or INCENP.

An inhibitor of LTB may, for example, be a peptide/polypeptide that is capable of blocking the interaction between LTB and LTBR, LTA, TNF, TNFSF14, TNFRSF1B, TNFSF13B, TNFRSF11A, CD40LG, MAP3K14, TNFSF11.

In some embodiments, an inhibitory peptide/polypeptide may comprise or consist of an amino acid sequence having at least 60%, e.g. one of at least 65%, 70%, 75%, 80%, 85%, 90%, 91%, 92%, 93%, 94%, 95%, 96%, 97%, 98% or 99% sequence identity to the amino acid sequence of an interaction partner for one or more of MFAP4, GRHPR, ITFG1, ABCC4, PAK3, TRNP1, APLN, KIF20A, and/or LTB, or the amino acid sequence of a fragment thereof.

In some embodiments, an inhibitory peptide/polypeptide may comprise or consist of an amino acid sequence having at least 60%, e.g. one of at least 65%, 70%, 75%, 80%, 85%, 90%, 91%, 92%, 93%, 94%, 95%, 96%, 97%, 98% or 99% sequence identity to the amino acid sequence of one or more of MFAP4, GRHPR, ITFG1, ABCC4, PAK3, TRNP1, APLN, KIF20A, and/or LTB, or the amino acid sequence of a fragment thereof. In such embodiments it will be appreciated that the inhibitory peptide/polypeptide will lack normal activity and/or have reduced activity compared to the wildtype version of the protein. For example, in some embodiments an inhibitory peptide/polypeptide may be a variant (e.g. mutant) version of MFAP4, GRHPR, ITFG1, ABCC4, PAK3, TRNP1, APLN, KIF20A, and/or LTB having reduced function relative to wildtype MFAP4, GRHPR, ITFG1, ABCC4, PAK3, TRNP1, APLN, KIF20A, and/or LTB.

Inhibitory peptides/polypeptides include aptamers. Nucleic acid aptamers are reviewed e.g. in Zhou and Rossi Nat Rev Drug Discov. 2017 16(3):181-202, and may be identified and/or produced by the method of Systematic Evolution of Ligands by EXponential enrichment (SELEX), or by developing SOMAmers (slow off-rate modified aptamers) (Gold L et al. (2010) PLoS ONE 5(12):e15004). Aptamers and SELEX are described in Tuerk and Gold, Science (1990) 249(4968):505-10, and in WO 91/19813. Nucleic acid aptamers may comprise DNA and/or RNA, and may be single stranded or double stranded. They may comprise chemically modified nucleic acids, for example in which the sugar and/or phosphate and/or base is chemically modified. Such modifications may improve the stability of the aptamer or make the aptamer more resistant to degradation and may include modification at the 2' position of ribose. Nucleic acid aptamers may be chemically synthesised, e.g. on a solid support. Solid phase synthesis may use phosphoramidite chemistry. Briefly, a solid supported nucleotide is detritylated, then coupled with a suitably activated nucleoside phosphoramidite to form a phosphite triester linkage. Capping may then occur, followed by oxidation of the phosphite triester with an oxidant, typically iodine. The cycle may then be repeated to assemble the aptamer (e.g., see Sinha, N. D.; Biernat, J.; McManus, J.; Köster, H. Nucleic Acids Res. 1984, 12, 4539; and Beaucage, S. L.; Lyer, R. P. (1992). Tetrahedron 48 (12): 2223). Peptide aptamers and methods for their generation and identification are reviewed in Reverdatto et al., Curr Top Med Chem. (2015) 15(12):1082-101, which is hereby incorporated by reference in its entirety.

Inhibitory peptides/polypeptides also include antibodies (immunoglobulins) such as monoclonal antibodies, polyclonal antibodies, monospecific antibodies, multispecific antibodies (e.g., bispecific antibodies), and fragments and derivatives thereof (e.g. Fv, scFv, Fab, scFab, F(ab')$_2$, Fab$_2$, diabodies, triabodies, scFv-Fc, minibodies, single domain antibodies (e.g. VhH), etc.).

In some embodiments, an inhibitor described herein is an antibody that is capable of binding to one or more of MFAP4, GRHPR, ITFG1, ABCC4, PAK3, TRNP1, APLN, KIF20A, and/or LTB.

An inhibitor of MFAP4 may be an antibody with catalog number PA5-42013 (ThermoFisher) or ab169757 (abcam). An inhibitor of GRHPR may be an antibody with catalog number PA5-54652 (ThermoFisher) or ab155604 (abcam). An inhibitor of ITFG1 may be an antibody with catalog number PA5-54067 (ThermoFisher) or TA339563 (ORIGENE). An inhibitor of ABCC4 may be an antibody with catalog number PA5-82019 (ThermoFisher) or ab15602 (abcam). An inhibitor of PAK3 may be an antibody with catalog number PA5-79781 (ThermoFisher) or ab40808 (abcam). An inhibitor of TRNP1 may be an antibody with catalog number PA5-71277 (ThermoFisher) or ab174303 (abcam). An inhibitor of APLN may be an APLN-blocking antibody. An inhibitor of APLN may be an antibody with catalog number PA5-114860 (ThermoFisher) or ab125213 (abcam). An inhibitor of KIF20A may be an antibody with catalog number PA5-38648 (ThermoFisher). An inhibitor of LTB may be an antibody (e.g. a recombinant Mouse Anti-LTA and LTB Antibody (CBL543)).

Inhibitors/inhibitory molecules that bind to any one of MFAP4, GRHPR, ITFG1, ABCC4, PAK3, TRNP1, APLN, KIF20A, and/or LTB, or that bind to an interacting partner thereof, may display specific binding to the relevant factor (i.e. the relevant mRNA/protein, or the interaction partner for said mRNA/protein). As used herein, "specific binding" refers to binding which is selective, and which can be discriminated from non-specific binding to non-target molecules.

An inhibitor or binding molecule that specifically binds to any one of MFAP4, GRHPR, ITFG1, ABCC4, PAK3, TRNP1, APLN, KIF20A, and/or LTB preferably binds to any one of MFAP4, GRHPR, ITFG1, ABCC4, PAK3, TRNP1, APLN, KIF20A, and/or LTB with greater affinity, and/or with greater duration than it binds to other, non-target molecules. Such binding molecules may be described as being "specific for" any one of MFAP4, GRHPR, ITFG1, ABCC4, PAK3, TRNP1, APLN, KIF20A, and/or LTB. An inhibitor or binding molecule that specifically binds to an interaction partner for any one of MFAP4, GRHPR, ITFG1, ABCC4, PAK3, TRNP1, APLN, KIF20A, and/or LTB preferably binds to the interaction partner for any one of MFAP4, GRHPR, ITFG1, ABCC4, PAK3, TRNP1, APLN, KIF20A, and/or LTB with greater affinity, and/or with greater duration than it binds to other, non-target molecules; such binding molecules may be described as being "specific for" the interaction partner for any one of MFAP4, GRHPR, ITFG1, ABCC4, PAK3, TRNP1, APLN, KIF20A, and/or LTB.

In some embodiments an inhibitor/binding molecule described herein inhibits the ability of any one of MFAP4, GRHPR, ITFG1, ABCC4, PAK3, TRNP1, APLN, KIF20A, and/or LTB to bind to a corresponding interaction partner (i.e. an interaction partner for MFAP4, GRHPR, ITFG1, ABCC4, PAK3, TRNP1, APLN, KIF20A, or LTB, respectively). In some embodiments the inhibitor/binding molecule behaves as a competitive inhibitor of interaction between any one of MFAP4, GRHPR, ITFG1, ABCC4, PAK3, TRNP1, APLN, KIF20A, and/or LTB and a corresponding interaction partner. The binding molecule may occupy, or otherwise reduce access to, a region of the protein required for binding to a corresponding interaction partner, or may occupy, or otherwise reduce access to, a region of an interaction partner required for binding to the corresponding protein.

The ability of an inhibitor, e.g. a binding molecule, to inhibit interaction between a protein of interest and a corresponding interaction partner can be evaluated e.g. by analysis of interaction in the presence of, or following incubation of one or both of the interaction partners with, the inhibitor. An example of a suitable assay to determine whether a given binding agent is capable of inhibiting interaction between a protein of interest and a corresponding interaction partner is a competition ELISA.

An inhibitor described herein may be a molecule capable of reducing expression of any one of MFAP4, GRHPR, ITFG1, ABCC4, PAK3, TRNP1, APLN, KIF20A, and/or LTB. A "molecule capable of reducing expression of any one of MFAP4, GRHPR, ITFG1, ABCC4, PAK3, TRNP1, APLN, KIF20A, and/or LTB" refers to a molecule which is capable of reducing gene, mRNA and/or protein expression of any one of MFAP4, GRHPR, ITFG1, ABCC4, PAK3, TRNP1, APLN, KIF20A, and/or LTB. In some embodiments the molecule reduces or prevents the expression of a polypeptide according to SEQ ID NO: 7156 to 7178. In some embodiments the molecule reduces or prevents the expression of a polypeptide from a sequence according to SEQ ID NO: 7179 to 7195.

Repression of expression of MFAP4, GRHPR, ITFG1, ABCC4, PAK3, TRNP1, APLN, KIF20A, or LTB or an isoform thereof will preferably result in a decrease in the quantity of MFAP4, GRHPR, ITFG1, ABCC4, PAK3, TRNP1, APLN, KIF20A, or LTB expressed by a cell/tissue/organ/organ system/subject. For example, in a given cell the repression of MFAP4, GRHPR, ITFG1, ABCC4, PAK3, TRNP1, APLN, KIF20A, or LTB by administration of a suitable nucleic acid will result in a decrease in the level of expression relative to an untreated cell. Repression may be partial. Preferred degrees of repression are at least 50%, more preferably one of at least 60%, 70%, 80%, 85% or 90%. A level of repression between 90% and 100% is considered a 'silencing' of expression or function. Gene and protein expression may be determined as described herein or by methods in the art that are well known to a skilled person.

In some embodiments, inhibition of MFAP4, GRHPR, ITFG1, ABCC4, PAK3, TRNP1, APLN, KIF20A, and/or LTB may comprise modification of a cell(s) to reduce or prevent expression of one or more of MFAP4, GRHPR, ITFG1, ABCC4, PAK3, TRNP1, APLN, KIF20A, and/or LTB. In some embodiments inhibition of MFAP4, GRHPR, ITFG1, ABCC4, PAK3, TRNP1, APLN, KIF20A, and/or LTB comprises modifying nucleic acid encoding one or more of MFAP4, GRHPR, ITFG1, ABCC4, PAK3, TRNP1, APLN, KIF20A, and/or LTB. The modification causes the cell to have a reduced level of gene and/or protein expression of MFAP4, GRHPR, ITFG1, ABCC4, PAK3, TRNP1, APLN, KIF20A, and/or LTB as compared to an unmodified cell.

In some embodiments inhibition of MFAP4, GRHPR, ITFG1, ABCC4, PAK3, TRNP1, APLN, KIF20A, and/or LTB may comprise modifying a gene encoding MFAP4, GRHPR, ITFG1, ABCC4, PAK3, TRNP1, APLN, KIF20A, and/or LTB.

In some embodiments inhibition of MFAP4, GRHPR, ITFG1, ABCC4, PAK3, TRNP1, APLN, KIF20A, and/or LTB comprises introducing an insertion, substitution or deletion into a nucleic acid sequence encoding MFAP4, GRHPR, ITFG1, ABCC4, PAK3, TRNP1, APLN, KIF20A, and/or LTB.

In some embodiments inhibition of MFAP4, GRHPR, ITFG1, ABCC4, PAK3, TRNP1, APLN, KIF20A, and/or LTB comprises introducing a modification which reduces or prevents the expression of a polypeptide according to any one of SEQ ID NO: 7156 to 7178 from the modified nucleic acid sequence. In some embodiments inhibition of MFAP4, GRHPR, ITFG1, ABCC4, PAK3, TRNP1, APLN, KIF20A, and/or LTB comprises modifying a cell to comprise an allele of MFAP4, GRHPR, ITFG1, ABCC4, PAK3, TRNP1, APLN, KIF20A, and/or LTB which does not encode an amino acid sequence according to any one of SEQ ID NO: 7156 to 7178. In some embodiments inhibition of MFAP4, GRHPR, ITFG1, ABCC4, PAK3, TRNP1, APLN, KIF20A, and/or LTB comprises modifying a cell to lack nucleic acid encoding a polypeptide according to any one of SEQ ID NO: 7156 to 7178.

In some embodiments inhibition of MFAP4, GRHPR, ITFG1, ABCC4, PAK3, TRNP1, APLN, KIF20A, and/or LTB comprises modifying the relevant gene(s) to introduce a premature stop codon in the sequence transcribed from said gene(s). In some embodiments inhibition of MFAP4, GRHPR, ITFG1, ABCC4, PAK3, TRNP1, APLN, KIF20A, and/or LTB comprises modifying the relevant gene(s) to encode a truncated and/or non-functional polypeptide(s). In some embodiments inhibition of MFAP4, GRHPR, ITFG1, ABCC4, PAK3, TRNP1, APLN, KIF20A, and/or LTB comprises modifying the relevant gene(s) to encode polypeptide(s) which is/are misfolded and/or degraded.

Methods for modifying nucleic acids encoding proteins of interest and agents for achieving the same are well known in the art, and include e.g. including modification of the target nucleic acid by homologous recombination, and target nucleic acid editing using site-specific nucleases (SSNs).

Suitable methods may employ targeting by homologous recombination, which is reviewed, for example, in Mortensen Curr Protoc Neurosci. (2007) Chapter 4:Unit 4.29 and Vasquez et al., PNAS 2001, 98(15): 8403-8410, both of which are hereby incorporated by reference in their entirety. Targeting by homologous recombination involves the exchange of nucleic acid sequence through crossover events guided by homologous sequences.

In some embodiments the methods employ target nucleic acid editing using SSNs. Gene editing using SSNs is reviewed e.g. in Eid and Mahfouz, Exp Mol Med. 2016 October; 48(10): e265, which is hereby incorporated by reference in its entirety. Enzymes capable of creating site-specific double strand breaks (DSBs) can be engineered to introduce DSBs to target nucleic acid sequence(s) of interest. DSBs may be repaired by either error-prone non-homologous end-joining (NHEJ), in which the two ends of the break are rejoined, often with insertion or deletion of nucleotides. Alternatively DSBs may be repaired by highly homology-directed repair (HDR), in which a DNA template with ends homologous to the break site is supplied and introduced at the site of the DSB.

SSNs capable of being engineered to generate target nucleic acid sequence-specific DSBs include zinc-finger nucleases (ZFNs), transcription activator-like effector nucleases (TALENs) and clustered regularly interspaced palindromic repeats/CRISPR-associated-9 (CRISPR/Cas9) systems.

ZFN systems are reviewed e.g. in Umov et al., Nat Rev Genet. (2010) 11(9):636-46, which is hereby incorporated by reference in its entirety. ZFNs comprise a programmable Zinc Finger DNA-binding domain and a DNA-cleaving domain (e.g. a FokI endonuclease domain). The DNA-binding domain may be identified by screening a Zinc Finger array capable of binding to the target nucleic acid sequence.

TALEN systems are reviewed e.g. in Mahfouz et al., Plant Biotechnol J. (2014) 12(8):1006-14, which is hereby incorporated by reference in its entirety. TALENs comprise a programmable DNA-binding TALE domain and a DNA-cleaving domain (e.g. a FokI endonuclease domain). TALEs comprise repeat domains consisting of repeats of 33-39 amino acids, which are identical except for two residues at positions 12 and 13 of each repeat which are repeat variable di-residues (RVDs). Each RVD determines binding of the repeat to a nucleotide in the target DNA sequence according to the following relationship: 'HD' binds to C, 'NI' binds to A, 'NG' binds to T and 'NN' or 'NK' binds to G (Moscou and Bogdanove, Science (2009) 326(5959):1501.).

CRISPR/Cas9 and related systems e.g. CRISPR/Cpf1, CRISPR/C2c1, CRISPR/C2c2 and CRISPR/C2c3 are reviewed e.g. in Nakade et al., Bioengineered (2017) 8(3): 265-273, which is hereby incorporated by reference in its entirety. These systems comprise an endonuclease (e.g. Cas9, Cpf1 etc.) and the single-guide RNA (sgRNA) molecule. The sgRNA can be engineered to target endonuclease activity to nucleic acid sequences of interest.

In some embodiments, inhibition of one or more of MFAP4, GRHPR, ITFG1, ABCC4, PAK3, TRNP1, APLN, KIF20A, and/or LTB employs a site-specific nuclease (SSN) system targeting the relevant nucleic acid sequence(s). Accordingly in some embodiments the inhibitor comprises or consists of an SSN system targeting nucleic acid(s) encoding one or more of MFAP4, GRHPR, ITFG1, ABCC4, PAK3, TRNP1, APLN, KIF20A, and/or LTB. In some embodiments inhibition of MFAP4, GRHPR, ITFG1, ABCC4, PAK3, TRNP1, APLN, KIF20A, and/or LTB employs nucleic acid(s) encoding a SSN system targeting the relevant nucleic acid sequence(s).

In some embodiments, the SSN system targets a region of the nucleic acid encoding a domain of a MFAP4, GRHPR, ITFG1, ABCC4, PAK3, TRNP1, APLN, KIF20A, and/or LTB protein required for protein function, e.g. a domain as described herein.

In some embodiments the SSN system is a ZFN system, a TALEN system, CRISPR/Cas9 system, a CRISPR/Cpf1 system, a CRISPR/C2c1 system, a CRISPR/C2c2 system or a CRISPR/C2c3 system. In some embodiments the SSN system is a CRISPR/Cas9 system. In such embodiments, the inhibition may employ nucleic acid(s) encoding a CRISPR RNA (crRNA) targeting nucleic acid encoding one or more of MFAP4, GRHPR, ITFG1, ABCC4, PAK3, TRNP1, APLN, KIF20A, and/or LTB, and a trans-activating crRNA (tracrRNA) for processing the crRNA to its mature form.

Nucleic Acid Inhibitors

In some embodiments, the inhibitor is a nucleic acid inhibitor. A nucleic acid inhibitor may also be described herein as an inhibitory nucleic acid.

Nucleic acid inhibitors according to the present disclosure may comprise or consist of DNA and/or RNA. Nucleic acid inhibitors may be single-stranded (e.g. in the case of antisense oligonucleotides (e.g. gapmers)). Nucleic acid inhibitors may be double-stranded or may comprise double-stranded region(s) (e.g. in the case of siRNA, shRNA, etc.). Inhibitory nucleic acids may comprise both double-stranded and single-stranded regions (e.g. in the case of shRNA and pre-miRNA molecules, which are double-stranded in the stem region of the hairpin structure, and single-stranded in the loop region of the hairpin structure).

In some embodiments, a nucleic acid inhibitor according to the present disclosure may be an antisense nucleic acid as described herein. In some embodiments, a nucleic acid inhibitor may comprise an antisense nucleic acid as described herein. In some embodiments, a nucleic acid inhibitor may encode an antisense nucleic acid as described herein.

As used herein, an 'antisense nucleic acid' refers to a nucleic acid (e.g. DNA or RNA) that is complementary to at least a portion of a target nucleotide sequence (e.g. of RNA encoding a target gene described herein). Antisense nucleic acids according to the present disclosure are preferably single-stranded nucleic acids, and bind via complementary Watson-Crick base-pairing to a target nucleotide sequence. Complementary base-pairing may involve hydrogen bonding between complementary base pairs. Antisense nucleic acids may be provided as single-stranded molecules, as for example in the case of antisense oligonucleotides, or may be comprised in double-stranded molecular species, as for example in the case of siRNA, shRNA and pre-miRNA molecules.

Complementary base-pairing between the antisense nucleic acid and its target nucleotide sequence may be complete. In such embodiments the antisense nucleic acid comprises, or consists of, the reverse complement of its target nucleotide sequence, and complementary base-pairing occurs between each nucleotide of the target nucleotide sequence and complementary nucleotides in the antisense nucleic acid. Alternatively, complementary base-pairing between the antisense nucleic acid and its target nucleotide sequence may be incomplete/partial. In such embodiments complementary base-pairing occurs between some, but not all, nucleotides of the target nucleotide sequence and complementary nucleotides in the antisense nucleic acid.

Such binding between nucleic acids through complementary base pairing may be referred to as 'hybridisation'. Through binding to its target nucleotide sequence, an antisense nucleic acid may form a nucleic acid complex comprising (i) the antisense nucleic acid and (ii) a target nucleic acid comprising the target nucleotide sequence.

The nucleotide sequence of an antisense nucleic acid is sufficiently complementary to its target nucleotide sequence such that it binds or hybridises to the target nucleotide sequence. It will be appreciated that an antisense nucleic acid preferably has a high degree of sequence identity to the reverse complement of its target nucleotide sequence. In some embodiments, the antisense nucleic acid comprises or consists of a nucleotide sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to the reverse complement of its target nucleotide sequence.

In some embodiments, an antisense nucleic acid according to the present disclosure comprises: a nucleotide sequence which is the reverse complement of its target nucleotide sequence, or a nucleotide sequence comprising 1 to 10 (e.g. one of 1, 2, 3, 4, 5, 6, 7, 8, 9 or 10) substitutions relative to the reverse complement of its target nucleotide sequence.

In some embodiments, the target nucleotide sequence for an antisense nucleic acid according to the present disclosure comprises, or consists of, 5 to 100 nucleotides, e.g. one of 10 to 80, 12 to 50, or 15 to 30 nucleotides (e.g. 20 to 27, e.g. ~21 to 23). In some embodiments, the target nucleotide sequence for an antisense nucleic acid according to the present disclosure comprises or consists of DNA and/or RNA. In some embodiments, the target nucleotide sequence for an antisense nucleic acid according to the present disclosure comprises or consists of RNA.

In some embodiments, the antisense nucleic acid reduces/prevents transcription of nucleic acid comprising its target nucleotide sequence. In some embodiments, the antisense nucleic acid reduces/prevents association of factors required for normal transcription (e.g. enhancers, RNA polymerase) with nucleic acid comprising its target nucleotide sequence.

In some embodiments, the antisense nucleic acid increases/potentiates degradation of nucleic acid comprising its target nucleotide sequence, e.g. through RNA interference. In some embodiments, the antisense nucleic acid reduces/prevents translation of nucleic acid comprising its target nucleotide sequence, e.g. through RNA interference or antisense degradation via RNase H.

RNA interference is described e.g. in Agrawal et al., Microbiol. Mol. Bio. Rev. (2003) 67(4): 657-685 and Hu et al., Sig. Transduc. Tar. Ther. (2020) 5(101), both of which are hereby incorporated by reference in their entirety. Briefly, double-stranded RNA molecules are recognised by the argonaute component of the RNA-induced silencing complex (RISC). The double-stranded RNAs are separated into single strands and integrated into an active RISC, by the RISC-Loading Complex (RLC). The RISC-integrated strands bind to their target RNA through complementary base pairing, and depending on the identity of the RISC-integrated RNA and degree of complementarity to the target RNA, the RISC then either cleaves the target RNA resulting in its degradation, or otherwise blocks access of ribosomes thereby preventing its translation. RNAi based therapeutics have been approved for a number of indications (Kim, Chonnam Med J. (2020) 56(2): 87-93).

In some embodiments, the antisense nucleic acid reduces/prevents normal post-transcriptional processing (e.g. splicing and/or translation) of nucleic acid comprising its target nucleotide sequence. In some embodiments, the antisense nucleic acid reduces or alters splicing of pre-mRNA comprising its target nucleotide sequence to mature mRNA. In some embodiments, the antisense nucleic acid reduces translation of mRNA comprising its target nucleotide sequence to protein.

In some embodiments, the antisense nucleic acid reduces/prevents association of factors required for normal post-transcriptional processing (e.g. components of the spliceosome) with nucleic acid comprising its target nucleotide sequence. In such instances, the antisense nucleic may be referred to as a 'splice-switching' nucleic acid.

Splice-switching nucleic acids are reviewed e.g. in Haves and Hastings, Nucleic Acids Res. (2016) 44(14): 6549-6563, which is hereby incorporated by reference in its entirety. Splice-switching nucleic acids include e.g. splice-switching oligonucleotides (SSOs). They disrupt the normal splicing of target RNA transcripts by blocking the RNA:RNA base-pairing and/or protein:RNA binding interactions that occur between components of the splicing machinery and pre-mRNA. Splice-switching nucleic acids may be employed to alter the number/proportion of mature mRNA transcripts encoding a protein described herein. Splice-switching nucleic acids may be designed to target a specific region of the target transcript, e.g. to effect skipping of exon(s) of interest, e.g. exons encoding domains/regions of interest. SSOs often comprise alterations to oligonucleotide sugar-phosphate backbones in order to reduce/prevent RNAse H degradation, such as e.g. phosphorothioate linkages, phosphorodiamidate linkages such as phosphorodiamidate morpholino (PMOs), and may comprise e.g. peptide nucleic acids (PNAs), locked nucleic acids (LNAs), methoxyethyl nucleotide modifications, e.g. 2'O-methyl (2'OMe) and 2'-O-methoxyethyl (MOE) ribose modifications and/or 5'-methylcytosine modifications.

In some embodiments, the antisense nucleic acid inhibits/reduces translation of nucleic acid comprising its target nucleotide sequence. In some embodiments, the antisense nucleic acid reduces/prevents association of factors required for translation (e.g. ribosomes) with nucleic acid comprising its target nucleotide sequence.

As used herein, "target sequence" refers to a contiguous portion of the nucleotide sequence of an mRNA molecule formed during the transcription of a gene (e.g. a gene associated with organ regeneration), including mRNA that is a product of RNA processing of a primary transcription product.

It will be appreciated that the target nucleotide sequence to which an antisense nucleic acid binds is a nucleotide sequence encoding a protein which it is desired to inhibit expression of. Accordingly, in aspects and embodiments of the present disclosure, the target nucleotide sequence for an antisense nucleic acid is a nucleotide sequence of a gene encoding any one or more of MFAP4, GRHPR, ITFG1, ABCC4, PAK3, TRNP1, APLN, KIF20A, and/or LTB.

In some embodiments, the target nucleotide sequence is a nucleotide sequence of RNA encoded by a gene encoding any one of MFAP4, GRHPR, ITFG1, ABCC4, PAK3, TRNP1, APLN, KIF20A, or LTB. In some embodiments, the target nucleotide sequence is a nucleotide sequence of RNA encoding any one of MFAP4, GRHPR, ITFG1, ABCC4, PAK3, TRNP1, APLN, KIF20A, or LTB. In some embodiments, the target nucleotide sequence comprises one or more nucleotides of an exon of RNA encoding any one of MFAP4, GRHPR, ITFG1, ABCC4, PAK3, TRNP1, APLN, KIF20A, or LTB. In some embodiments, the target nucleotide sequence is a nucleotide sequence of an exon of RNA encoding any one of MFAP4, GRHPR, ITFG1, ABCC4, PAK3, TRNP1, APLN, KIF20A, or LTB.

In some embodiments, the target nucleotide sequence is a nucleotide sequence provided in Table 14.

In some embodiments, the target nucleotide sequence is a nucleotide sequence of NM_001198695.2 (GI: 1677501926, version 2), which is the NCBI Reference Sequence for human MFAP4 transcript variant 1 mRNA (SEQ ID NO: 7179), or a portion thereof. In some embodiments, the target nucleotide sequence is a nucleotide sequence of NM_002404.3 (GI: 1677501522, version 3), which is the NCBI Reference Sequence for human MFAP4 transcript variant 2 mRNA (SEQ ID NO: 7180), or a portion thereof.

In some embodiments, the target nucleotide sequence is a nucleotide sequence of NM_012203.2 (GI: 1519473711, version 2) which is the NCBI Reference Sequence for human GRHPR transcript variant 1 mRNA (SEQ ID NO: 7181), or a portion thereof.

In some embodiments, the target nucleotide sequence is a nucleotide sequence of NM_030790.5 (GI: 1653961895, version 5) which is the NCBI Reference Sequence for human ITFG1 transcript variant 1 mRNA (SEQ ID NO: 7182), or a portion thereof.

In some embodiments, the target nucleotide sequence is a nucleotide sequence of NM_005845.5 (GI: 1813751621, version 5) which is the NCBI Reference Sequence for human ABCC4 transcript variant 1 mRNA (SEQ ID NO: 7183), or a portion thereof. In some embodiments, the target nucleotide sequence is a nucleotide sequence of NM_001105515.3 (GI: 1677498821, version 3) which is the NCBI Reference Sequence for human ABCC4 transcript variant 2 mRNA (SEQ ID NO: 7184), or a portion thereof. In some embodiments, the target nucleotide sequence is a nucleotide sequence of NM_001301829.2 (GI: 1677530022, version 2) which is the NCBI Reference Sequence for human ABCC4 transcript variant 3 mRNA (SEQ ID NO: 7185), or a portion thereof. In some embodiments, the target nucleotide sequence is a nucleotide sequence of NM_001301830.2 (GI: 1677498275, version 2) which is the NCBI Reference Sequence for human ABCC4 transcript variant 4 mRNA (SEQ ID NO: 7186), or a portion thereof.

In some embodiments, the target nucleotide sequence is a nucleotide sequence of NM_001128166.3 (GI: 1889680926, version 3) which is the NCBI Reference Sequence for human PAK3 transcript variant 1 mRNA (SEQ ID NO: 7187), or a portion thereof. In some embodiments, the target nucleotide sequence is a nucleotide sequence of NM_002578.5 (GI: 1519316149, version 5) which is the NCBI Reference Sequence for human PAK3 transcript variant 2 mRNA (SEQ ID NO: 7188), or a portion thereof. In some embodiments, the target nucleotide sequence is a nucleotide sequence of NM_001128167.3 (GI: 1890283404, version 3) which is the NCBI Reference Sequence for human PAK3 transcript variant 3 mRNA (SEQ ID NO: 7189), or a portion thereof. In some embodiments, the target nucleotide sequence is a nucleotide sequence of NM_001128168.3 (GI: 1676441496, version 3) which is the NCBI Reference Sequence for human PAK3 transcript variant 4 mRNA (SEQ ID NO: 7190), or a portion thereof.

In some embodiments, the target nucleotide sequence is a nucleotide sequence of NM_001013642.3 (GI: 1519242294, version 3) which is the NCBI Reference Sequence for human TRNP1 mRNA (SEQ ID NO: 7191), or a portion thereof.

In some embodiments, the target nucleotide sequence is a nucleotide sequence of NM_017413.5 (GI: 1519315208, version 5) which is the NCBI Reference Sequence for human APLN mRNA (SEQ ID NO: 7192), or a portion thereof.

In some embodiments, the target nucleotide sequence is a nucleotide sequence of NM_005733.3 (GI: 1519313609, version 3) which is the NCBI Reference Sequence for human KIF20A transcript variant 1 mRNA (SEQ ID NO: 7193), or a portion thereof.

In some embodiments, the target nucleotide sequence is a nucleotide sequence of NM_002341.2 (GI: 1720810086, version 2) which is the NCBI Reference Sequence for human LTB transcript variant 1 mRNA (SEQ ID NO: 7194), or a portion thereof. In some embodiments, the target nucleotide sequence is a nucleotide sequence of NM_009588.1 (GI: 6996015, version 1) which is the NCBI Reference Sequence for human LTB transcript variant 2 mRNA (SEQ ID NO: 7195), or a portion thereof.

In some embodiments, the antisense nucleic acid comprises or consists of a sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to the reverse complement of any one of SEQ ID NOs: 7179 to 7195, or a portion thereof, e.g. calculated over the length of the antisense nucleic acid or over the length of the portion of the reference sequence.

In some embodiments, the antisense nucleic acid comprises or consists of a sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to any one of SEQ ID NOs: 7179 to 7195, or a portion thereof, e.g. calculated over the length of the antisense nucleic acid or over the length of the portion of the reference sequence.

In some embodiments the antisense nucleic acid and/or the portion of the reference sequence is 5 to 50, 5 to 40, 8 to 30, 8 to 25, 10 to 25, 15 to 25, or 19 to 22 nucleotides in length. Antisense nucleic acids described herein may comprise thymine or uracil residues. Where antisense nucleic acids described herein are defined by reference to sequence identity with a reference sequence, the nucleic acids may comprise uracil residues in place of any thymine residues in the reference sequence, or vice versa.

In some embodiments, the antisense nucleic acid comprises or consists of a sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to a sequence, or to the reverse complement of a sequence, in any one or more of Tables 1, 2, 3, 4, 5, 6, 7, 8, 9, 10, 11, 12 and/or 13, e.g. calculated over the length of the antisense nucleic acid or over the length of the reference sequence from a Table.

In some embodiments, the antisense nucleic acid comprises or consists of a sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to any one or more of SEQ ID NOs: 1 to 7155, or to the reverse complement of any one or more of SEQ ID NOs: 1 to 7155, e.g. calculated over the length of the antisense nucleic acid or the length of the reference sequence.

In some embodiments, the antisense nucleic acid comprises or consists of a sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to any one or more of SEQ ID NOs: 14 to 7114 or 7141 to 7155, or to the reverse complement of any one or more of SEQ ID NOs: 14 to 7114 or 7141 to 7155, e.g. calculated over the length of the antisense nucleic acid or the length of the reference sequence.

In some embodiments, the antisense nucleic acid comprises or consists of a sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to any one of SEQ ID NOs: 1 to 13, or to the reverse complement of any one of SEQ ID NOs: 1 to 13, e.g. calculated over the length of the antisense nucleic acid or over the length of the reference sequence.

In some embodiments, the antisense nucleic acid comprises or consists of a sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to any one of SEQ ID NOs: 7115 to 7140, or to the reverse complement of any one of SEQ ID NOs: 7115 to 7140, e.g. calculated over the length of the antisense nucleic acid or over the length of the reference sequence.

In some embodiments, the antisense nucleic acid comprises or consists of a sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to any one or more of SEQ ID NOs: 14 to 347, and/or to the reverse complement of any one or more of SEQ ID NOs: 14 to 347, e.g. calculated over the length of the antisense nucleic acid or over the length of the reference sequence. The antisense nucleic acid may be capable of reducing gene and/or protein expression of MFAP4, e.g. human MFAP4.

In some embodiments, the antisense nucleic acid comprises or consists of a sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to SEQ ID NOs: 1, 2, 15, 19 or 25, and/or to the reverse complement of SEQ ID NOs: 1, 2, 15, 19, or 25, e.g. calculated over the length of the antisense nucleic acid or over the length of the reference sequence. The antisense nucleic acid may be capable of reducing gene and/or protein expression of MFAP4, e.g. human MFAP4.

In some embodiments, the antisense nucleic acid comprises or consists of a sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to SEQ ID NOs: 7092, 7093, 7141, 7142, 7146, 7147, 7151, 7152 and/or 7097 to 7102, and/or to the reverse complement of SEQ ID NOs: 7092, 7093, 7141, 7142, 7146, 7147, 7151, 7152 and/or 7097 to 7102, e.g. calculated over the length of the antisense nucleic acid or over the length of the reference sequence. The antisense nucleic acid may be capable of reducing gene and/or protein expression of MFAP4, e.g. human MFAP4.

In some embodiments, the antisense nucleic acid comprises or consists of a sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to SEQ ID NOs: 7097 or 7100, and/or to the reverse complement of SEQ ID NOs: 7097 or 7100, e.g. calculated over the length of the antisense nucleic acid or over the length of the reference sequence. The antisense nucleic acid may be capable of reducing gene and/or protein expression of MFAP4, e.g. human MFAP4.

In some embodiments, the antisense nucleic acid comprises or consists of a sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to any one or more of SEQ ID NOs: 7115 to 7120, and/or to the reverse complement of any one or more of SEQ ID NOs: 7115 to 7120, e.g. calculated over the length of the antisense nucleic acid or over the length of the reference sequence. The antisense nucleic acid may be capable of reducing gene and/or protein expression of MFAP4, e.g. mouse MFAP4.

In some embodiments, the antisense nucleic acid comprises or consists of a sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to any one or more of SEQ ID NOs: 348 to 456, and/or to the reverse complement of any one or more of SEQ ID NOs: 348 to 456, e.g. calculated over the length of the antisense nucleic acid or over the length of the reference sequence. The antisense nucleic acid may be capable of reducing gene and/or protein expression of GRHPR, e.g. human GRHPR.

In some embodiments, the antisense nucleic acid comprises or consists of a sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to any one or more of SEQ ID NOs: 3, 4, 5, 349, 350 and/or 351, and/or to the reverse complement of any one or more of SEQ ID NOs: 3, 4, 5, 349, 350, and/or 351, e.g. calculated over the length of the antisense nucleic acid or over the length of the reference sequence. The antisense nucleic acid may be capable of reducing gene and/or protein expression of GRHPR, e.g. human GRHPR.

In some embodiments, the antisense nucleic acid comprises or consists of a sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to any one or more of SEQ ID NOs: 7094, 7143, 7148, 7153 and/or 7103 to 7108, and/or to the reverse complement of any one or more of SEQ ID NOs: 7094, 7143, 7148, 7153 and/or 7103 to 7108, e.g. calculated over the length of the antisense nucleic acid or over the length of the reference sequence. The antisense nucleic acid may be capable of reducing gene and/or protein expression of GRHPR, e.g. human GRHPR.

In some embodiments, the antisense nucleic acid comprises or consists of a sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to any one or more of SEQ ID NOs: 7121 to 7129, and/or to the reverse complement of any one or more of SEQ ID NOs: 7121 to 7129, e.g. calculated over the length of the antisense nucleic acid or over the length of the reference sequence. The antisense nucleic acid may be capable of reducing gene and/or protein expression of GRHPR, e.g. mouse GRHPR.

In some embodiments, the antisense nucleic acid comprises or consists of a sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to any one or more of SEQ ID NOs: 457 to 1482, and/or to the reverse complement of any one or more of SEQ ID NOs: 457 to 1482, e.g. calculated over the length of the antisense nucleic acid or over the length of the reference sequence. The antisense nucleic acid may be capable of reducing gene and/or protein expression of ITFG1, e.g. human ITFG1.

In some embodiments, the antisense nucleic acid comprises or consists of a sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to any one or more of SEQ ID NOs: 6, 7, 457, 465, 468, 470, and/or 473, and/or to the reverse complement of any one or more of SEQ ID NOs: 6, 7, 457, 465, 468, 470, and/or 473, e.g. calculated over the length of the antisense nucleic acid or over the length of the reference sequence. The antisense nucleic acid may be capable of reducing gene and/or protein expression of ITFG1, e.g. human ITFG1.

In some embodiments, the antisense nucleic acid comprises or consists of a sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to any one or more of SEQ ID NOs: 7095, 7096, 7144, 7145, 7149, 7150, 7154, 7155, and/or 7109 to 7114, and/or to the reverse complement of any one or more of SEQ ID NOs: 7095, 7096, 7144, 7145, 7149, 7150, 7154, 7155, and/or 7109 to 7114, e.g. calculated over the length of the antisense nucleic acid or over the length of the reference sequence. The antisense nucleic acid may be capable of reducing gene and/or protein expression of ITFG1, e.g. human ITFG1.

In some embodiments, the antisense nucleic acid comprises or consists of a sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to any one or more of SEQ ID NOs: 7130 to 7140, and/or to the reverse complement of any one or more of SEQ ID NOs: 7130 to 7140, e.g. calculated over the length of the antisense nucleic acid or over the length of the reference sequence. The antisense nucleic acid may be capable of reducing gene and/or protein expression of ITFG1, e.g. mouse ITFG1.

In some embodiments, the antisense nucleic acid comprises or consists of a sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to any one or more of SEQ ID NOs: 1483 to 2208, and/or to the reverse complement of any one or more of SEQ ID NOs: 1483 to 2208, e.g. calculated over the length of the antisense nucleic acid or over the length of the reference sequence. The antisense nucleic acid may be capable of reducing gene and/or protein expression of ABCC4, e.g. human ABCC4.

In some embodiments, the antisense nucleic acid comprises or consists of a sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to any one or more of SEQ ID NOs: 1483, 1485, 1486, 1488, 1489 and/or 1490, and/or to the reverse complement of any one or more of SEQ ID NOs: 1483, 1485, 1486, 1488, 1489 and/or 1490, e.g. calculated over the length of the antisense nucleic acid or over the length of the reference sequence. The antisense nucleic acid may be capable of reducing gene and/or protein expression of ABCC4, e.g. human ABCC4.

In some embodiments, the antisense nucleic acid comprises or consists of a sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to any one or more of SEQ ID NOs: 2209 to 5060, and/or to the reverse complement of any one or more of SEQ ID NOs: 2209 to 5060, e.g. calculated over the length of the antisense nucleic acid or over the length of the reference sequence. The antisense nucleic acid may be capable of reducing gene and/or protein expression of PAK3, e.g. human PAK3.

In some embodiments, the antisense nucleic acid comprises or consists of a sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to any one or more of SEQ ID NOs: 2209, 2225 and/or 2234, and/or to the reverse complement of any one or more of SEQ ID NOs: 2209, 2225 and/or 2234 e.g. calculated over the length of the antisense nucleic acid or over the length of the reference sequence. The antisense nucleic acid may be capable of reducing gene and/or protein expression of PAK3, e.g. human PAK3.

In some embodiments, the antisense nucleic acid comprises or consists of a sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to any one or more of SEQ ID NOs: 5061 to 5389, and/or to the reverse complement of any one or more of SEQ ID NOs: 5061 to 5389, e.g. calculated over the length of the antisense nucleic acid or over the length of the reference sequence. The antisense nucleic acid may be capable of reducing gene and/or protein expression of TRNP1, e.g. human TRNP1.

In some embodiments, the antisense nucleic acid comprises or consists of a sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to any one or more of SEQ ID NOs: 5061 and/or 5062, and/or to the reverse complement of any one or more of SEQ ID NOs: 5061 and/or 5062 e.g. calculated over the length of the antisense nucleic acid or over the length of the reference sequence. The antisense nucleic acid may be capable of reducing gene and/or protein expression of TRNP1, e.g. human TRNP1.

In some embodiments, the antisense nucleic acid comprises or consists of a sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to any one or more of SEQ ID NOs: 5390 to 5966, and/or to the reverse complement of any one or more of SEQ ID NOs: 5390 to 5966, e.g. calculated over the length of the antisense nucleic acid or over the length of the reference sequence. The antisense nucleic acid may be capable of reducing gene and/or protein expression of APLN, e.g. human APLN.

In some embodiments, the antisense nucleic acid comprises or consists of a sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to any one or more of SEQ ID NOs: 5390, 5391, 5392 and/or 5393, and/or to the reverse complement of any one or more of SEQ ID NOs: 5390, 5391, 5392 and/or 5393, e.g. calculated over the length of the antisense nucleic acid or over the length of the reference sequence. The antisense nucleic acid may be capable of reducing gene and/or protein expression of APLN, e.g. human APLN.

In some embodiments, the antisense nucleic acid comprises or consists of a sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to any one or more of SEQ ID NOs: 5967 to 6974, and/or to the reverse complement of any one or more of SEQ ID NOs: 5967 to 6974, e.g. calculated over the length of the antisense nucleic acid or over the length of the reference sequence. The antisense nucleic acid may be capable of reducing gene and/or protein expression of KIF20A, e.g. human KIF20A.

In some embodiments, the antisense nucleic acid comprises or consists of a sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to any one or more of SEQ ID NOs: 5967, 5970 and/or 5971, and/or to the reverse complement of any one or more of SEQ ID NOs: 5967, 5970 and/or 5971, e.g. calculated over the length of the antisense nucleic acid or over the length of the reference sequence. The antisense nucleic acid may be capable of reducing gene and/or protein expression of KIF20A, e.g. human KIF20A.

In some embodiments, the antisense nucleic acid comprises or consists of a sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to any one or more of SEQ ID NOs: 6975 to 7091, and/or to the reverse complement of any one or more of SEQ ID NOs: 6975 to 7091, e.g. calculated over the length of the antisense nucleic acid or over the length of the reference sequence. The antisense nucleic acid may be capable of reducing gene and/or protein expression of LTB, e.g. human LTB.

In some embodiments, the antisense nucleic acid comprises or consists of a sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to any one or more of SEQ ID NOs: 6977, 6978 and/or 6993, and/or to the reverse complement of any one or more of SEQ ID NOs: 6977, 6978 and/or 6993, e.g. calculated over the length of the antisense nucleic acid or over the length of the reference sequence. The antisense nucleic acid may be capable of reducing gene and/or protein expression of LTB, e.g. human LTB.

The antisense nucleic acid may comprise or consist of a sequence that hybridises to a sequence listed in any of Tables 1 to 14, or a sequence that hybridises to the complement of a sequence listed in any of Tables 1 to 14.

In some embodiments, a nucleic acid inhibitor is an antisense oligonucleotide (ASO). ASOs are single-stranded nucleic acid molecules comprising or consisting of an antisense nucleic acid to a target nucleotide sequence. An antisense oligonucleotide according to the present disclosure may comprise or consist of an antisense nucleic acid as described herein.

ASOs can modify expression of RNA molecules comprising their target nucleotide sequence by altering splicing, or by recruiting RNase H to degrade RNA comprising the target nucleotide sequence. RNase H recognises nucleic acid complex molecules formed when the ASO binds to RNA comprising its target nucleotide sequence. ASOs according to the present disclosure may comprise or consist of an antisense nucleic acid according to the present disclosure. ASOs may comprise 10 to 40 (e.g. 17 to 30, 20 to 27, 21 to 23) nucleotides in length. Many ASOs are designed as chimeras, comprising a mix of bases with different chemistries, or as gapmers, comprising a central DNA portion surrounded by 'wings' of modified nucleotides. ASOs are described in e.g. Scoles et al., Neurol Genet. 2019 April; 5(2): e323. ASOs sometimes comprise alterations to the sugar-phosphate backbone in order to increase their stability and/or reduce/prevent RNAse H degradation, such as e.g. phosphorothioate linkages, phosphorodiamidate linkages such as phosphorodiamidate morpholino (PMOs), and may comprise e.g. peptide nucleic acids (PNAs), locked nucleic acids (LNAs), methoxyethyl nucleotide modifications, e.g. 2'O-methyl (2'OMe) and 2'-O-methoxyethyl (MOE) ribose modifications and/or 5'-methylcytosine modifications.

In some embodiments, a nucleic acid inhibitor is selected from: an siRNA, dsiRNA, miRNA, shRNA, pri-miRNA, pre-miRNA, saRNA, snoRNA, or antisense oligonucleotide (e.g. a gapmer), or a nucleic acid encoding the same. In some embodiments, a nucleic acid inhibitor is selected from: an siRNA, dsiRNA, miRNA, shRNA. In some embodiments, a nucleic acid inhibitor is an siRNA. In some embodiments, a nucleic acid inhibitor is an shRNA.

The nucleic acid inhibitor may be an RNAi agent (e.g. siRNA, shRNA or miRNA-based shRNA or gRNA for CRISR/CAS9 knockout) or a nucleic acid encoding an RNAi agent that reduces expression of a gene/mRNA, e.g. one or more of MFAP4, GRHPR, ITFG1, ABCC4, PAK3, TRNP1, APLN, KIF20A, and/or LTB.

In some embodiments, an inhibitory nucleic acid may comprise an antisense nucleic acid described herein, e.g. as part of a larger nucleic acid species. For example, in some embodiments, an inhibitory nucleic acid may be an siRNA, dsiRNA, miRNA, shRNA, pri-miRNA, pre-miRNA, saRNA or snoRNA comprising an antisense nucleic acid described herein.

In some embodiments, an inhibitory nucleic acid is a small interfering RNA (siRNA). As used herein, 'siRNA' refers to a double-stranded RNA molecule having a length between 17 to 30 (e.g. 20 to 27, e.g. ~21 to 23) base pairs, which is capable of engaging the RNA interference (RNAi) pathway for the targeted degradation of target RNA. Double-stranded siRNA molecules may be formed as a nucleic acid complex of RNA strands having a high degree of complementarity. The strand of the double-stranded siRNA molecule having complementarity to a target nucleotide sequence (i.e. the antisense nucleic acid) may be referred to as the 'guide' strand, and the other strand may be referred to as the 'passenger' strand. The structure and function of siRNAs is described e.g. in Kim and Rossi, Biotechniques. 2008 April; 44(5): 613-616.

The RNAi agent may contain one or more overhang regions and/or capping groups at the 3'-end, 5'-end, or both ends of one or both strands e.g. comprising one or two or three nucleotides (e.g. a 'UU'3' overhang, a 'TT' 3' overhang, or a 'CCA' 5' overhang). The overhang can be 1-6 nucleotides in length, for instance 2-6 nucleotides in length, 1-5 nucleotides in length, 2-5 nucleotides in length, 1-4 nucleotides in length, 2-4 nucleotides in length, 1-3 nucleotides in length, 2-3 nucleotides in length, or 1-2 nucleotides in length. The overhangs can be the result of one strand being longer than the other, or the result of two strands of the same length being staggered. The overhang can form a mismatch with the target mRNA or it can be complementary to the gene sequences being targeted or can be another sequence. The first and second strands can also be joined, e.g., by additional bases to form a hairpin, or by other non-base linkers.

In some embodiments, a passenger strand of an siRNA according to the present disclosure may comprise a 'CCA' modification at the 5' end, i.e. the addition of nucleotides 'CCA'. In some embodiments, a passenger strand of an siRNA according to the present disclosure may comprise a 'TT' modification at the 3' end, e.g. replacing the 3' two nucleotides.

In some embodiments, the guide strand of an siRNA according to the present disclosure may comprise or consist of an antisense nucleic acid according to an embodiment of an antisense nucleic acid described herein.

In some embodiments an siRNA according to the present disclosure (e.g. in Tables 1-11) may be contained within a longer shRNA sequence (e.g. in Tables 12 and 13) that undergoes processing to form the siRNA.

The term "RNAi agent" or "RNAi" as used interchangeably herein, refer to an agent that contains RNA as that term is defined herein, and which mediates the targeted cleavage of an RNA transcript via an RNA-induced silencing complex (RISC) pathway. RNAi agent directs the sequence-specific degradation of mRNA through a process known as RNA interference (RNAi). The RNAi agent modulates, e.g., inhibits, the expression of a gene associated with organ regeneration in a cell, e.g., a cell within a subject, such as a mammalian subject. The term "RNAi agent" includes both shRNAs (e.g. in Table 12 or 13), or precursor RNAs that are processed by RISC into siRNAs (e.g. in Tables 1 to 11), as well as the siRNAs themselves that inhibits the expression of an endogenous gene.

The invention provides for double-stranded RNAi agents capable of inhibiting the expression of a target gene in vivo. The RNAi agent may comprise a sense strand and an antisense strand. Each strand of the RNAi agent may range from 12-30 nucleotides in length. For example, each strand may be between 14-30 nucleotides in length, 17-30 nucleotides in length, 25-30 nucleotides in length, 27-30 nucleotides in length, 17-23 nucleotides in length, 17-21 nucleotides in length, 17-19 nucleotides in length, 19-25 nucleotides in length, 19-23 nucleotides in length, 19-21 nucleotides in length, 21-25 nucleotides in length, or 21-23 nucleotides in length.

The sense strand and antisense strand typically form a duplex double stranded RNA ("dsRNA"). The duplex region of an RNAi agent may be 12-30 nucleotide pairs in length. For example, the duplex region can be between 14-30 nucleotide pairs in length, 17-30 nucleotide pairs in length, 27-30 nucleotide pairs in length, 17-23 nucleotide pairs in length, 17-21 nucleotide pairs in length, 17-19 nucleotide pairs in length, 19-25 nucleotide pairs in length, 19-23 nucleotide pairs in length, 19-21 nucleotide pairs in length, 21-25 nucleotide pairs in length, or 21-23 nucleotide pairs in length. In another example, the duplex region is selected from 15, 16, 17, 18, 19, 20, 21, 22, 23, 24, 25, 26, and 27 nucleotides in length.

In some embodiments, an inhibitory nucleic acid is a dicer small interfering RNA (dsiRNA). As used herein, 'dsiRNA' refers to a double-stranded RNA molecule having a length of ~27 base pairs, which is processed by Dicer to siRNA for RNAi-mediated degradation of target RNA. DsiRNAs are described e.g. in Raja et al., Asian J Pharm Sci. (2019) 14(5): 497-510, which is hereby incorporated by reference in their entirety. DsiRNAs are optimised for Dicer processing and may have increased potency compared with 21-mer siRNAs (see e.g. Kim et al., Nat Biotechnol. (2005) 23(2):222-226), which may be related to the link between Dicer-mediated nuclease activity and RISC loading.

In some embodiments, an inhibitory nucleic acid is a micro RNA (miRNA), or a precursor thereof (e.g. a pri-miRNA or a pre-miRNA). miRNA molecules have a similar structure to siRNA molecules, but are encoded endogenously, and derived from processing of short hairpin RNA molecules. They are initially expressed as long primary transcripts (pri-miRNAs), which are processed within the nucleus into 60 to 70 nucleotide hairpins (pre-miRNAs), which are further processed in the cytoplasm into smaller species that interact with RISC and target mRNA. miRNAs comprise 'seed sequences' that are essential for binding to target mRNA. Seed sequences usually comprise six nucleotides and are situated at positions 2 to 7 at the miRNA 5' end.

In some embodiments, an inhibitory nucleic acid is a short hairpin RNA (shRNA), e.g. as provided in Tables 12 and 13 (showing sense-loop-antisense sequences). shRNA molecules comprise sequences of nucleotides having a high degree of complementarity that associate with one another through complementary base pairing to form the stem region of the hairpin. The sequences of nucleotides having a high degree of complementarity may be linked by one or more nucleotides that form the loop region of the hairpin. shRNA molecules may be processed (e.g. via catalytic cleavage by DICER) to form siRNA or miRNA molecules. shRNA molecules may have a length of between 35 to 100 (e.g. 40 to 70) nucleotides. The stem region of the hairpin may have a length between 17 to 30 (e.g. 20 to 27, e.g. ~21-23) base pairs. The stem region may comprise G-U pairings to stabilise the hairpin structure. An shRNA sequence described herein may comprise sequences that will be subsequently processed into shorter siRNA strand(s), such as the guide/passenger strands presented in Tables 1-11.

siRNA, dsiRNA, miRNAs and shRNAs for the targeted inhibition of gene and/or protein expression of one or more of MFAP4, GRHPR, ITFG1, ABCC4, PAK3, TRNP1, APLN, KIF20A, or LTB may be identified/designed in accordance with principles and/or using tools well known to the skilled person. Parameters and tools for designing siRNA and shRNA molecules are described e.g. in Fakhr et al., Cancer Gene Therapy (2016) 23:73-82 (hereby incorporated by reference in its entirety). Software that may be used by the skilled person for the design of such molecules is summarised in Table 1 of Fakhr et al., Cancer Gene Therapy (2016) 23:73-82, and includes e.g. siRNA Wizard (InvivoGen). Details for making such molecules can be found in the websites of commercial vendors such as Ambion, Dharmacon, GenScript, Invitrogen and Oligo-Engine.

In some embodiments, an inhibitory nucleic acid according to the present disclosure comprises: (i) nucleic acid comprising the nucleotide sequence of any one or more of SEQ ID NOs: 1 to 7091, or a nucleotide sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to one of SEQ ID NOs: 1 to 7091; and (ii) nucleic acid comprising a nucleotide sequence having the reverse complement of the nucleotide sequence of (i), or having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to the reverse complement of the nucleotide sequence of (i). SEQ ID NOs 1 to 7091 are displayed in Tables 1 to 10 provided herein. The nucleic acid according to the present disclosure may be capable of reducing gene and/or protein expression of any one of MFAP4, GRHPR, ITFG1, ABCC4, PAK3, TRNP1, APLN, KIF20A, or LTB, according to the heading of the Table in which the SEQ ID NO is presented. For example, a SEQ ID NO presented in Table 2 may be capable of reducing gene and/or protein expression of MFAP4.

In some embodiments, an inhibitory nucleic acid according to the present disclosure comprises: (i) nucleic acid comprising the nucleotide sequence of any one or more of SEQ ID NOs: 7092 to 7096, or a nucleotide sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to one of SEQ ID NOs: 7092 to 7096; and (ii) nucleic acid comprising a nucleotide sequence having the reverse complement of the nucleotide sequence of (i), or having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to the reverse complement of the nucleotide sequence of (i).

In some embodiments, an inhibitory nucleic acid according to the present disclosure comprises: (i) nucleic acid comprising the nucleotide sequence of SEQ ID NO: 7092, or a nucleotide sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to SEQ ID NO: 7092; and (ii) nucleic acid comprising a nucleotide sequence of SEQ ID NO: 7141, or having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to SEQ ID NO: 7141.

In some embodiments, an inhibitory nucleic acid according to the present disclosure comprises: (i) nucleic acid comprising the nucleotide sequence of SEQ ID NO: 7093, or a nucleotide sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to SEQ ID NO: 7093; and (ii) nucleic acid comprising a nucleotide sequence of SEQ ID NO: 7142, or having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to SEQ ID NO: 7142.

In some embodiments, an inhibitory nucleic acid according to the present disclosure comprises: (i) nucleic acid comprising the nucleotide sequence of SEQ ID NO: 7094, or a nucleotide sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to SEQ ID NO: 7094; and (ii) nucleic acid comprising a nucleotide sequence of SEQ ID NO: 7143, or having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to SEQ ID NO: 7143.

In some embodiments, an inhibitory nucleic acid according to the present disclosure comprises: (i) nucleic acid comprising the nucleotide sequence of SEQ ID NO: 7095, or a nucleotide sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to SEQ ID NO: 7095; and (ii) nucleic acid comprising a nucleotide sequence of SEQ ID NO: 7144, or having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to SEQ ID NO: 7144.

In some embodiments, an inhibitory nucleic acid according to the present disclosure comprises: (i) nucleic acid comprising the nucleotide sequence of SEQ ID NO: 7096, or a nucleotide sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to SEQ ID NO: 7096; and (ii) nucleic acid comprising a nucleotide sequence of SEQ ID NO: 7145, or having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to SEQ ID NO: 7145.

In some embodiments in accordance with the preceding seven paragraphs, the nucleotide sequence of (i) and the nucleotide sequence of (ii) may be provided on different nucleic acids (i.e. separate oligonucleotides). As such, the nucleic acid of (i) and (ii) may be different nucleic acids. In such embodiments, the inhibitory nucleic acid may comprise or consist of a nucleic acid duplex formed by complementary base pairing between the different nucleic acids comprising the nucleotide sequences of (i) and (ii).

Alternatively, in some embodiments the nucleotide sequence of (i) and the nucleotide sequence of (ii) may be provided on the same nucleic acid (i.e. a single oligonucleotide). That is, the nucleic acid of (i) and (ii) may be the same nucleic acid. In such embodiments, the nucleotide sequence of (i) and the nucleotide sequence of (ii) may be connected by one or more linker nucleotides. The inhibitory nucleic acid may comprise a nucleic acid duplex region formed by complementary base pairing between the nucleotide sequences of (i) and (ii), and the linker regions may form a single-stranded loop region.

Disclosed herein is a nucleic acid inhibitor consisting, comprising or encoding an RNAi agent having at least 70%, 80%, 90% or 95% sequence identity to an RNA sequence listed in any of Tables 1 to 13 (or any combination of Tables thereof) or an RNAi agent that hybridizes to the complement of an RNA sequence listed in any of Tables 1 to 13 (or any combination of Tables thereof) under stringency conditions.

Disclosed herein is a nucleic acid inhibitor consisting, comprising or encoding an RNAi agent having at least 70%, 80%, 90% or 95% sequence identity to an RNA sequence listed in any of Tables 2-12 (or any combination of Tables thereof) or an RNAi agent that hybridizes to the complement of an RNA sequence listed in any of Tables 2-12 (or any combination of Tables thereof) under stringency conditions.

Disclosed herein is a nucleic acid inhibitor consisting, comprising or encoding an RNAi agent having at least 70%, 80%, 90% or 95% sequence identity to an RNA sequence listed in Table 1 or 13, or an RNAi agent that hybridizes to the complement of an RNA sequence listed in Table 1 or 13 under stringency conditions.

The terms "nucleic acid" and "polynucleotide', used interchangeably herein, refer to polymeric forms of nucleotides of any length, either ribonucleotides or deoxyribonucleotides. Thus, these terms include, but are not limited to, single-, double-, or multi-stranded DNA or RNA, genomic DNA, cDNA, DNA-RNA hybrids, or a polymer comprising purine and pyrimidine bases or other natural, chemically or biochemically modified, non-natural, or derivatized nucleotide bases. These terms further include, but are not limited to, mRNA or cDNA that comprise intronic sequences. The backbone of the polynucleotide can comprise sugars and phosphate groups (as may typically be found in RNA or DNA), or modified or substituted sugar or phosphate groups. Alternatively, the backbone of the polynucleotide can comprise a polymer of synthetic subunits such as phosphoramidites and thus can be an oligodeoxynucleoside phosphoramidate or a mixed phosphoramidate-phosphodiester oligomer. A polynucleotide may comprise modified nucleotides, such as methylated nucleotides and nucleotide analogs, uracyl, other sugars, and linking groups such as fluororibose and thioate, and nucleotide branches. The sequence of nucleotides may be interrupted by non-nucleotide components. A polynucleotide may be further modified after polymerization, such as by conjugation with a labeling component. Other types of modifications included in this definition are caps, substitution of one or more of the naturally occurring nucleotides with an analog, and introduction of means for attaching the polynucleotide to proteins, metal ions, labeling components, other polynucleotides, or a solid support. The term "polynucleotide" also encompasses peptidic nucleic acids, PNA and LNA. Polynucleotides may further comprise genomic DNA, cDNA, or DNA-RNA hybrids.

The term "RNA" or "RNA molecule" or "ribonucleic acid molecule" refers to a polymer of ribonucleotides. The term "DNA" or "DNA molecule" or deoxyribonucleic acid molecule" refers to a polymer of deoxyribonucleotides. DNA and RNA can be synthesized naturally (e.g., by DNA replication or transcription of DNA, respectively). RNA can be post-transcriptionally modified. DNA and RNA can also be chemically synthesized. DNA and RNA can be single-stranded (i.e., ssRNA and ssDNA, respectively) or multi-stranded (e.g., double stranded, i.e., dsRNA and dsDNA, respectively). "mRNA" or "messenger RNA" is single-stranded RNA that specifies the amino acid sequence of one or more polypeptide chains. This information is translated during protein synthesis when ribosomes bind to the mRNA.

"Stringency conditions" refers to conditions under which a nucleic acid may hybridize to its target polynucleotide sequence, but not other sequences. Stringent conditions are sequence-dependent (e.g., longer sequences hybridize specifically at higher temperatures). Generally, stringent conditions are selected to be about 5° C. lower than the thermal melting point (Tm) for the specific sequence at a defined ionic strength and pH. The Tm is the temperature (under defined ionic strength, pH, and polynucleotide concentration) at which 50% of the probes complementary to the target sequence hybridize to the target sequence at equilibrium. Typically, stringent conditions will be those in which the salt concentration is at least about 0.01 to about 1.0 M sodium ion concentration (or other salts) at about pH 7.0 to about pH 8.3 and the temperature is at least about 30° C. for short probes (e.g., 10 to 50 nucleotides).

As used herein, the term "complement" when used in reference to a nucleic acid sequence refers to the complementary sequence of the nucleic acid sequence as dictated by base-pairing, but in reverse orientation so as to result in complementarity upon fold-over into a hairpin structure. The term encompasses partial complementarity where only some of the bases are matched according to base pairing rules as well as total complementarity between the two nucleic acid sequences.

Modifications

Nucleic acid inhibitors/inhibitory nucleic acids according to the present disclosure may comprise chemically modified nucleotide acids, e.g. in which the phosphonate and/or ribose and/or base is/are chemically modified. Such modifications may influence the activity, specificity and/or stability of nucleic acid. One or more (e.g. one of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or all) nucleotides of a nucleic acid inhibitor may comprise such chemical modification.

Modifications contemplated in accordance with nucleic acid inhibitors according to the present disclosure include those described in Hu et al., Sig. Transduc. Tar. Ther. (2020) 5(101) (incorporated by reference hereinabove), in particular those shown in FIG. 2 of Hu et al., Sig. Transduc. Tar. Ther. (2020) 5(101). Further modifications contemplated in accordance with nucleic acid inhibitors according to the present disclosure include those described in Selvam et al., Chem Biol Drug Des. (2017) 90(5): 665-678, which is hereby incorporated by reference in its entirety).

In some embodiments, an inhibitory nucleic acid according to the present disclosure comprises one or more nucleotides comprising a phosphonate modification. In some embodiments, the phosphonate modification(s) may be selected from: phosphorothioate (e.g. Rp isomer, Sp isomer), phosphorodithioate, methylphosphonate, methoxypropylphosphonate, 5'-(E)-vinylphosphonate, 5'-methylphosphonate, (S)-5'-C-methyl with phosphate, 5'-phosphorothioate, and peptide nucleic acid. In some embodiments, aa nucleic acid inhibitor comprises one or more nucleotides comprising phosphorothioate modification.

In some embodiments, an inhibitory nucleic acid according to the present disclosure comprises one or more nucleotides comprising a ribose modification. In some embodiments, the ribose modification(s) may be selected from: 2'-O-methyl, 2'-O-methoxyethyl, 2'-fluoro, 2'-deoxy-2'- fluoro, 2'-methoxyethyl, 2'-O-alkyl, 2'-O-allyl, 2'-C-allyl, 2'-deoxy, 2'-hydroxyl, 2'-arabino-fluoro, 2'-O-benzyl, 2'-O-methyl-4-pyridine, locked nucleic acid, (S)-cEt-BNA, tricyclo-DNA, PMO, unlocked nucleic acid, hexitol nucleic acid and glycol nucleic acid. In some embodiments, an inhibitory nucleic acid comprises one or more nucleotides comprising 2'-O-methyl modification. In some embodiments, an inhibitory nucleic acid comprises one or more nucleotides comprising 2'-fluoro modification.

In some embodiments, an inhibitory nucleic acid according to the present disclosure comprises one or more nucleotides comprising a base modification. In some embodiments, the base modification(s) may be selected from: pseudouridine, 2'-thiouridine, N6'-methyladenosine, 5'-methylcytidine, 5'-fluoro-2'-deoxyuridine, N-ethylpiperidine 7-EAA triazole-modified adenine, N-ethylpiperidine 6'-triazole-modified adenine, 6'-phenylpyrrolo-cytosine, 2',4'-difluorotoluyl ribonucleoside and 5'-nitroindole.

In some embodiments, an inhibitory nucleic acid according to the present disclosure comprises: one or more nucleotides comprising phosphorothioate modification, one or more nucleotides comprising 2'-O-methyl modification, and one or more nucleotides comprising 2'-fluoro modification.

In some embodiments, an inhibitory nucleic acid according to the present disclosure comprises one or more modified nucleotides selected from: 2'-O-methyluridine-3-phosphate, 2'-O-methyladenosine-3'-phosphate, 2'-O-methylguanosine-3'-phosphate, 2'-O-methylcytidine-3-phosphate, 2'-O-methyluridine-3'-phosphorothioate, 2'-O-methyladenosine-3'-phosphorothioate, 2'-O-methylguanosine-3'-phosphorothioate, 2'-O-methylcytidine-3'-phosphorothioate, 2'-fluorouridine-3-phosphate, 2'-fluoroadenosine-3'-phosphate, 2'-fluoroguanosine-3'-phosphate, 2'-fluorocytidine-3'-phosphate, 2'-fluorocytidine-3'-phosphorothioate, 2'-fluoroguanosine-3'-phosphorothioate, 2'-fluoroadenosine-3'-phosphorothioate, and 2'-fluorouridine-3'-phosphorothioate.

In some embodiments, an inhibitory nucleic acid according to the present disclosure comprises a nucleotide sequence comprising 3 to 10 (e.g. one of 3, 4, 5, 6, 7, 8, 9 or 10) nucleotides comprising 2'-fluoro modification. In some embodiments, an inhibitory nucleic acid according to the present disclosure comprises 4 to 15 (e.g. one of 4, 5, 6, 7, 8, 9, 10, 11, 12, 13, 14 or 15) nucleotides comprising 2'-fluoro modification. In some embodiments, an inhibitory nucleic acid according to the present disclosure comprises a nucleotide sequence comprising 2 to 6 (e.g. one of 2, 3, 4, 5 or 6) nucleotides comprising phosphorothioate modification. In some embodiments, an inhibitory nucleic acid according to the present disclosure comprises 5 to 20 (e.g. one of 5, 6, 7, 8, 9, 10, 11, 12, 13, 14, 15, 16, 17, 18, 19 or 20) nucleotides comprising 2'-O-methyl modification. In some embodiments, an inhibitory nucleic acid according to the present disclosure comprises a nucleotide sequence comprising 2 to 6 (e.g. one of 2, 3, 4, 5 or 6) nucleotides comprising 2'-O-methyl and phosphorothioate modification. In some embodiments, an inhibitory nucleic acid according to the present disclosure comprises a nucleotide sequence comprising 1 to 4 (e.g. one of 1, 2, 3 or 4) nucleotides comprising 2'-fluoro and phosphorothioate modification.

In embodiments wherein nucleic acid inhibitors/inhibitory nucleic acids comprise nucleotides comprising chemical modification as described herein, the nucleotide sequence is nevertheless evaluated for the purposes of sequence comparison in accordance with the present disclosure as if the equivalent unmodified nucleotide were instead present.

Nucleic acids comprising nucleotide(s) comprising a modified phosphonate group are evaluated for the purposes of nucleotide sequence comparison as if nucleotide(s) comprising a modified phosphonate group instead comprise the equivalent unmodified phosphonate group. Nucleic acids comprising nucleotide(s) comprising a modified ribose group are evaluated for the purposes of nucleotide sequence comparison as if nucleotide(s) comprising a modified ribose group instead comprise the equivalent unmodified ribose group. Nucleic acids comprising nucleotide(s) comprising a modified base group are evaluated for the purposes of nucleotide sequence comparison as if nucleotide(s) comprising a modified base group instead comprise the equivalent unmodified base group.

By way of illustration, nucleic acids comprising nucleotides comprising pseudouridine, 2-thiouridine and/or 5'-fluoro-2'-deoxyuridine are evaluated for the purposes of nucleotide sequence comparison as if nucleotides comprising uridine were instead present at their respective positions. By way of illustration, nucleic acids comprising nucleotides comprising N6'-methyladenosine, N-ethylpiperidine 7'-EAA triazole-modified adenine and/or N-ethylpiperidine 6'-triazole-modified adenine are evaluated for the purposes of nucleotide sequence comparison as if nucleotides comprising adenine were instead present at their respective positions. By way of illustration, nucleic acids comprising nucleotides comprising 5'-methylcytidine and/or 6'-phenylpyrrolo-cytosine are evaluated for the purposes of nucleotide sequence comparison as if nucleotides comprising cytosine were instead present at their respective positions.

In some embodiments, an inhibitory nucleic acid according to the present disclosure comprises nucleic acid comprising the nucleotide sequence (including the modifications thereto) shown in Table 11.

In some embodiments, an inhibitory nucleic acid comprises nucleic acid comprising the nucleotide sequence (including the modifications thereto) shown in any one or more of SEQ ID NOs: 7146 to 7155 of Table 11. The following six paragraphs refer to SEQ ID NOs presented in Table 11.

In some embodiments, an inhibitory nucleic acid according to the present disclosure comprises: (i) nucleic acid comprising the nucleotide sequence (including the modifications thereto) of any one of SEQ ID NOs: 7146 to 7150, or a nucleotide sequence (including the modifications thereto) having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to one of SEQ ID NOs: 7146 to 7150; and (ii) nucleic acid comprising the nucleotide sequence (including the modifications thereto) of any one of SEQ ID NOs: 7151 to 7155, or a nucleotide sequence (including the modifications thereto) having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to one of SEQ ID NOs: 7151 to 7155.

In some embodiments, an inhibitory nucleic acid according to the present disclosure comprises: (i) nucleic acid comprising the nucleotide sequence (including the modifications thereto) of SEQ ID NO: 7146, or a nucleotide sequence (including the modifications thereto) having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to SEQ ID NO: 7146; and (ii) nucleic acid comprising the nucleotide sequence (including the modifications thereto) of SEQ ID NO: 7151, or a nucleotide sequence (including the modifications thereto) having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to SEQ ID NO: 7151.

In some embodiments, an inhibitory nucleic acid according to the present disclosure comprises: (i) nucleic acid comprising the nucleotide sequence (including the modifications thereto) of SEQ ID NO: 7147, or a nucleotide sequence (including the modifications thereto) having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to SEQ ID NO: 7147; and (ii) nucleic acid comprising the nucleotide sequence (including the modifications thereto) of SEQ ID NO: 7152, or a nucleotide sequence (including the modifications thereto) having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to SEQ ID NO: 7152.

In some embodiments, an inhibitory nucleic acid according to the present disclosure comprises: (i) nucleic acid comprising the nucleotide sequence (including the modifications thereto) of SEQ ID NO: 7148, or a nucleotide sequence (including the modifications thereto) having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to SEQ ID NO: 7148; and (ii) nucleic acid comprising the nucleotide sequence (including the modifications thereto) of SEQ ID NO: 7153, or a nucleotide sequence (including the modifications thereto) having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to SEQ ID NO: 7153.

In some embodiments, an inhibitory nucleic acid according to the present disclosure comprises: (i) nucleic acid comprising the nucleotide sequence (including the modifications thereto) of SEQ ID NO: 7149, or a nucleotide sequence (including the modifications thereto) having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to SEQ ID NO: 7149; and (ii) nucleic acid comprising the nucleotide sequence (including the modifications thereto) of SEQ ID NO: 7154, or a nucleotide sequence (including the modifications thereto) having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to SEQ ID NO: 7154.

In some embodiments, an inhibitory nucleic acid according to the present disclosure comprises: (i) nucleic acid comprising the nucleotide sequence (including the modifications thereto) of SEQ ID NO: 7150, or a nucleotide sequence (including the modifications thereto) having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to SEQ ID NO: 7150; and (ii) nucleic acid comprising the nucleotide sequence (including the modifications thereto) of SEQ ID NO: 7155, or a nucleotide sequence (including the modifications thereto) having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to SEQ ID NO: 7155.

In general, the majority of nucleotides of each strand of a dsRNA molecule are ribonucleotides, but as described in detail herein, each or both strands can also include one or more non-ribonucleotides, e.g., a deoxyribonucleotide and/or a modified nucleotide. In addition, an "RNAi agent" may include ribonucleotides with chemical modifications; an RNAi agent may include substantial modifications at multiple nucleotides. Such modifications may include all types of modifications disclosed herein or known in the art. Any such modifications, as used in a siRNA type molecule, are encompassed by "RNAi agent" for the purposes of this specification and claims.

In one embodiment, each residue of the sense strand and antisense strand is independently modified with LNA, HNA, CeNA, 2'-methoxyethyl, 2'-O-methyl, 2'-O-allyl, 2'-C-allyl, 2'-deoxy, 2'-hydroxyl, or 2'-fluoro. The strands can contain more than one modification.

Inhibitory nucleic acids according to the present disclosure may be produced in accordance with techniques well known to the skilled person.

For example, inhibitory nucleic acids may be produced recombinantly by transcription of a nucleic acid sequence encoding the inhibitory nucleic acid. A nucleic acid encoding an inhibitory nucleic acid according to the present disclosure may e.g. be contained within an expression vector for expression of the inhibitory nucleic acid.

Transcription may be performed in cell-free transcription reactions using recombinant enzymes (e.g. RNA polymerase) for transcription of the inhibitory nucleic acids. Alternatively, production of an inhibitory nucleic acid according to the present disclosure may be performed in a cell comprising nucleic acid encoding the inhibitory nucleic acid, and may employ cellular enzymes (e.g. RNA polymerase) for transcription. Production of an inhibitory nucleic acid according to the present disclosure by expression within a cell may comprise transcription from a vector. Introduction of nucleic acid/vectors for the purposes of production of inhibitory nucleic acids according to the present disclosure may be performed in any of the ways known in the art (e.g. transfection, transduction, electroporation, etc.). Expression of an inhibitory nucleic acid can be regulated using a cell-specific promoter (e.g. a liver cell-specific promoter).

For example, an shRNA molecule according to the present disclosure may be produced within a cell by transcription from a vector encoding the shRNA. shRNAs may be produced within a cell by transfecting the cell with a vector encoding the shRNA sequence under control of an RNA polymerase promoter.

An siRNA molecule according to the present disclosure may be produced within a cell by transcription from a vector encoding shRNA encoding/comprising the siRNA, and subsequent processing of the shRNA molecule by cellular DICER to form the siRNA molecule. An shRNA molecule according to the present disclosure, e.g. a sequence in Table 12 or 13, may be embedded into and expressed using a miR-30-based system, e.g. as described in Fellmann C et al., Cell Rep. 2013; 5(6):1704-13, and Rio D C et al., Cold Spring Harb Protoc; 2013; doi:10.1101/pdb.prot075853, which are hereby incorporated by reference in their entirety.

Inhibitory nucleic acids may also be synthesised using standard solid or solution phase synthesis techniques which are well known in the art. Solid phase synthesis may use phosphoramidite chemistry. Briefly, a solid supported nucleotide may be detrytilated, then coupled with a suitably activated nucleoside phosphoramidite to form a phosphite triester linkage. Capping may then occur, followed by oxidation of the phosphite triester with an oxidant, typically iodine. The cycle may then be repeated to yield a polynucleotide.

The present disclosure provides nucleic acid comprising or encoding an inhibitory nucleic acid according to the present disclosure. In some embodiments, nucleic acid comprising or encoding an inhibitory nucleic acid comprises, or consists of, DNA and/or RNA.

The present disclosure also provides a vector comprising the nucleic acid comprising or encoding an inhibitory nucleic acid according to the present disclosure.

Nucleic acids and vectors according to the present disclosure may be provided in purified or isolated form, i.e. from other nucleic acid, or naturally-occurring biological material.

The nucleotide sequence of a nucleic acid comprising or encoding an inhibitory nucleic acid according to the present disclosure may be contained in a vector, e.g. an expression vector. A 'vector' as used herein is a nucleic acid molecule used as a vehicle to transfer exogenous nucleic acid into a cell. The vector may be a vector for expression of the nucleic acid in the cell. Such vectors may include a promoter sequence operably linked to the nucleotide sequence encoding the sequence to be expressed. A vector may also include a termination codon and expression enhancers. Any suitable vectors, promoters, enhancers and termination codons known in the art may be used to express nucleic acid from a vector according to the present disclosure.

The term 'operably linked' may include the situation where a selected nucleic acid sequence and regulatory nucleic acid sequence (e.g. promoter and/or enhancer) are covalently linked in such a way as to place the expression of nucleic acid sequence under the influence or control of the regulatory sequence (thereby forming an expression cassette). Thus, a regulatory sequence is operably linked to the selected nucleic acid sequence if the regulatory sequence is capable of affecting transcription of the nucleic acid sequence.

Suitable vectors include plasmids, binary vectors, DNA vectors, mRNA vectors, viral vectors (e.g. gammaretroviral vectors (e.g. murine Leukemia virus (MLV)-derived vectors), lentiviral vectors, adenovirus vectors, adeno-associated virus vectors, vaccinia virus vectors and herpesvirus vectors), transposon-based vectors, and artificial chromosomes (e.g. yeast artificial chromosomes).

In some embodiments, the vector may be a eukaryotic vector, e.g. a vector comprising the elements necessary for expression of nucleic acid from the vector in a eukaryotic cell. In some embodiments, the vector may be a mammalian vector, e.g. comprising a cytomegalovirus (CMV) or SV40 promoter to drive expression. In some embodiments, the vector comprises a cell- or tissue-specific promoter. In some embodiments, the vector comprises a liver cell-specific promoter.

The present disclosure also provides a plurality of inhibitory nucleic acids according to the present disclosure. The present disclosure also provides nucleic acids and vectors comprising or encoding a plurality of inhibitory nucleic acids according to the present disclosure.

Individual inhibitory nucleic acids of a plurality of inhibitory nucleic acids according to the present disclosure may be identical or non-identical. Similarly, in embodiments wherein a nucleic acid/vector comprising or encoding an inhibitory nucleic acid according to the present disclosure comprises/encodes more than one inhibitory nucleic acid according to the present disclosure, the inhibitory nucleic acids comprised/encoded by the nucleic acid/vector may be identical or non-identical.

In some embodiments, nucleic acids/vectors may encode one of 1, 2, 3, 4, 5, 6, 7, 8, 9, 10, 11, 12, 13, 14, 15, 16, 17, 18, 19 or 20 inhibitory nucleic acids according to the present disclosure. In some embodiments, nucleic acids/vectors may encode multiple (e.g. 2, 3, 4, 5, 6, 7, 8, 9, 10, etc.) copies of a given inhibitory nucleic acid according to the present disclosure.

In some embodiments, a plurality of inhibitory nucleic acids according to the present disclosure may be a plurality of non-identical inhibitory nucleic acids. In some embodiments, a plurality of inhibitory nucleic acids may comprise one of 1, 2, 3, 4, 5, 6, 7, 8, 9, 10, 11, 12, 13, 14, 15, 16, 17, 18, 19 or 20 non-identical inhibitory nucleic acids. In some embodiments, nucleic acids/vectors may comprise/encode a plurality of non-identical inhibitory nucleic acids according to the present disclosure.

The following two paragraphs further define pluralities of non-identical inhibitory nucleic acids in accordance with embodiments of pluralities of inhibitory nucleic acids according to the present disclosure, and also in accordance with embodiments of nucleic acids/vectors comprising/encoding a plurality of non-identical inhibitory nucleic acids according to the present disclosure.

In some embodiments, the non-identical inhibitory nucleic acids comprise or encode non-identical antisense nucleic acids. In such embodiments, the non-identical antisense nucleic acids may each independently conform to any embodiment of an antisense nucleic acid as described hereinabove.

In some embodiments, the non-identical inhibitory nucleic acids may comprise or encode antisense nucleic acids targeting non-identical target nucleotide sequences. In such embodiments, the non-identical target nucleotide sequences may each independently conform to any embodiment of a target nucleotide sequence for an antisense nucleic acid as described hereinabove.

The present disclosure also provides a cell comprising or expressing (i) an inhibitory nucleic acid according to the present disclosure, (ii) nucleic acid comprising or encoding an inhibitory nucleic acid according to the present disclosure, and/or (iii) a vector comprising nucleic acid comprising or encoding an inhibitory nucleic acid according to the present disclosure.

The cell may be a eukaryotic cell, e.g. a mammalian cell. The mammal may be a primate (rhesus, cynomolgous, non-human primate or human) or a non-human mammal (e.g. rabbit, guinea pig, rat, mouse or other rodent (including any animal in the order Rodentia), cat, dog, pig, sheep, goat, cattle (including cows, e.g. dairy cows, or any animal in the order Bos), horse (including any animal in the order Equidae), donkey, and non-human primate). In preferred embodiments, the cell may be a human cell. In some embodiments, the cell may be a liver cell.

The present disclosure also provides a method for producing a cell comprising a nucleic acid or vector according to the present disclosure, comprising introducing a nucleic acid or vector according to the present disclosure into a cell. In some embodiments, introducing a nucleic acid or vector according to the present disclosure into a cell comprises transformation, transfection, electroporation or transduction (e.g. retroviral transduction).

The present disclosure also provides a method for producing an inhibitory nucleic acid according to the present disclosure or a nucleic acid comprising or encoding an inhibitory nucleic acid according to the present disclosure, comprising culturing a cell comprising nucleic acid comprising or encoding an inhibitory nucleic acid according to the present disclosure or a vector according to the present disclosure under conditions suitable for expression of the nucleic acid or vector by the cell. In some embodiments, the methods are performed in vitro.

The present disclosure also provides compositions comprising nucleic acids (including inhibitory nucleic acids, nucleic acids comprising/encoding an inhibitory nucleic acid, expression vectors comprising/encoding such nucleic acids) or cells according to the present disclosure.

In therapeutic and prophylactic applications, the inhibitors and compositions of the present disclosure are preferably formulated as a medicament or pharmaceutical composition (suitable for clinical use). Such compositions may comprise the inhibitor or cell together with one or more other pharmaceutically-acceptable ingredients well known to those skilled in the art. Such ingredients include, but are not limited to, pharmaceutically-acceptable carriers, adjuvants, excipients, diluents, fillers, buffers, preservatives, anti-oxidants, lubricants, stabilisers, solubilisers, surfactants (e.g., wetting agents), masking agents, colouring agents, flavouring agents, and sweetening agents.

Provided herein is a pharmaceutical composition comprising an inhibitor as defined herein and a pharmaceutically acceptable carrier.

Compositions according to the present disclosure may be prepared by any methods well known in the art of pharmacy. Such methods include the step of bringing into association the active compound with a carrier which constitutes one or more accessory ingredients. In general, the formulations are prepared by uniformly and intimately bringing into association the active compound with carriers (e.g., liquid carriers, finely divided solid carrier, etc.), and then shaping the product, if necessary.

The compositions may be prepared for topical, parenteral, systemic, intracavitary, intravenous, intra-arterial, intramuscular, intrathecal, intraocular, intravitreal, intraconjunctival, subretinal, suprachoroidal, subcutaneous, intradermal, intrathecal, oral, nasal or transdermal routes of administration which may include injection or infusion. Suitable formulations may comprise the selected agent in a sterile or isotonic medium. The formulation and mode of administration may be selected according to the agent to be administered, and disease to be treated/prevented.

The pharmaceutical compositions of the present invention may be administered in a number of ways depending upon whether local or systemic treatment is desired and upon the area to be treated. Administration may be topical (including intranasal or intrapulmonary), oral or parenteral. Parenteral administration includes intravenous, subcutaneous, intraperitoneal or intramuscular injection.

The compositions of the present disclosure may be formulated in fluid, including gel, form. Fluid formulations may be formulated for administration by injection or infusion (e.g. via catheter) to a selected organ or region of the human or animal body. A further aspect of the present disclosure relates to a method of formulating or producing a medicament or pharmaceutical composition according to the present disclosure, the method comprising formulating a pharmaceutical composition or medicament by mixing an agent with a pharmaceutically acceptable carrier, adjuvant, excipient or diluent.

Delivery of Inhibitors

Inhibitors (including e.g. small molecules, antibodies and nucleic acids (including inhibitory nucleic acids, expression vectors)), cells and compositions according to the present disclosure may be modified and/or be formulated to facilitate delivery to, and/or uptake by, a cell/tissue of interest, e.g. a liver cell (hepatocyte) or hepatic tissue.

Strategies for targeted delivery of such species are reviewed e.g. in Li et al., Int. J. Mol. Sci. (2015) 16: 19518-19536 and Fu et al., Bioconjug Chem. (2014) 25(9): 1602-1608, which are hereby incorporated by reference in their entirety. In particular, nucleic acids according to the present disclosure may employ a delivery platform described in Hu et al., Sig. Transduc. Tar. Ther. (2020) 5(101) (incorporated by reference hereinabove), or Tatiparti et al. 'siRNA Delivery Strategies: A Comprehensive Review of Recent Developments.' Ed. Thomas Nann. Nanomaterials 7.4 (2017): 77, and Lehto T et al., Adv Drug Deliv Rev. 2016, 106(Pt A):172-182, which are hereby incorporated by reference in their entirety.

In some embodiments, articles of the present disclosure may be encapsulated in a nanoparticle or a liposome. In some embodiments, articles of the present disclosure may be (covalently or non-covalently) associated with a cell-penetrating peptide (e.g. a protein transduction domain, trojan peptide, arginine-rich peptide, vectocell peptide), a cationic polymer, a cationic lipid or a viral carrier.

Nanoparticles may be organic, e.g. micelles, liposomes, proteins, solid-lipid particles, solid polymer particles, dendrimers, and polymer therapeutics. Nanoparticles may be inorganic, e.g. such as nanotubes or metal particles, optionally with organic molecules added. In some embodiments, a nanoparticle is a nanoparticle described in Chen et al., Mol Ther Methods Clin Dev. (2016) 3:16023, which is hereby incorporated by reference in its entirety. In some embodiments, a nanoparticle is a PLGA, polypeptide, poly(β-amino ester), DOPE, β-cyclodextrin-containing polycation, linear PEI, PAMAM dendrimer, branched PEI, chitosan or polyphosphoester nanoparticle.

The delivery of a nucleic acid inhibitor, e.g. an RNAi agent, to a cell e.g., a cell within a subject, such as a human subject can be achieved in a number of different ways. For example, delivery may be performed by contacting a cell with a nucleic acid of the invention either in vitro or in vivo. In vivo delivery may also be performed directly by administering a composition comprising a nucleic acid inhibitor, e.g., a siRNA, shRNA, dsRNA, to a subject. Alternatively, in vivo delivery may be performed indirectly by administering one or more vectors (e.g. one or more DNA vectors) that encode and direct the expression of the nucleic acid inhibitor. In one embodiment, the nucleic acid inhibitor is delivered using a viral-based or transposon-based nucleic acid construct. In one embodiment, the nucleic acid inhibitor is encapsulated in a liposome.

In some embodiments, an inhibitor according to the present disclosure (e.g. a small molecule, a peptide, an antibody, an inhibitory nucleic acid, a nucleic acid comprising/encoding an inhibitory nucleic acid, or an expression vector) comprises modification to incorporate one or more moieties facilitating delivery to, and/or uptake by, a cell type or tissue of interest. In some embodiments, an inhibitor according to the present disclosure is linked (e.g. chemically conjugated to) one or more moieties facilitating delivery to, and/or uptake by, a cell type or tissue of interest.

Modification to, and formulation of, inhibitors to facilitate targeted delivery to cell types and/or tissues of interest is described e.g. in Lorenzer et al., J Control Release (2015) 203:1-15, which is hereby incorporated by reference in its entirety. The moiety facilitating delivery to, and/or uptake by, a cell type or tissue of interest may bind selectively to the target cell type/tissue of interest. The moiety may facilitate traversal of the cell membrane of the target cell type and/or of cells of the tissue of interest. The moiety may bind to a molecule expressed at the cell surface of the target cell type/tissue of interest. The moiety may facilitate internalisation of the nucleic acid by the target cell type/tissue of interest (e.g. by endocytosis).

Moieties facilitating delivery to, and/or uptake by, cell types or tissues of interest are described e.g. in Benizri et al., Bioconjug Chem. (2019) 30(2): 366-383, which is hereby incorporated by reference in its entirety. Such moieties include e.g. N-acetylgalactosamine (GalNAc), α-tocopherol, cell-penetrating peptide, nucleic acid aptamer, antibody and antigen-binding fragments/derivatives thereof, cholesterol, squalene, polyethylene glycol (PEG), fatty acid (e.g. palmitic acid) and nucleolipid moieties.

In some embodiments, the moiety may e.g. be a peptide/polypeptide (e.g. an antibody, fragment or derivative thereof, peptide aptamer or cell-penetrating peptide) or nucleic acid (e.g. a nucleic acid aptamer) which binds to the target cell type/tissue of interest, e.g. via interaction with a molecule expressed at the cell surface of the target cell type/tissue of interest.

In some embodiments, a nucleic acid according to the present disclosure comprises a moiety facilitating delivery to, and/or uptake by, a liver cell (e.g. a hepatocyte) and/or hepatic tissue. In such embodiments, the moiety may facilitate traversal of the hepatocyte cell membrane. The moiety may bind to a molecule expressed at the cell surface of hepatocytes. In some embodiments, a molecule expressed at the cell surface of hepatocytes is an asialoglycoprotein receptor, e.g. ASGR1 or ASGR2. The moiety may facilitate internalisation of a nucleic acid by hepatocytes (e.g. by endocytosis).

In some embodiments, the moiety may e.g. be a peptide/polypeptide (e.g. an antibody, fragment or derivative thereof, peptide aptamer or cell-penetrating peptide) or nucleic acid (e.g. a nucleic acid aptamer) which binds to a hepatocyte and/or hepatic tissue, e.g. via interaction with a molecule expressed at the cell surface of a hepatocyte (e.g. an asialoglycoprotein receptor, e.g. ASGR1 or ASGR2).

In some embodiments, the moiety is, or comprises, GalNAc. In some embodiments, an inhibitor, e.g. a nucleic acid, is conjugated to GalNAc. GalNAc interacts with asialoglycoprotein receptors expressed by hepatocytes. Nucleic acids conjugated to GalNAc are efficiently internalised by hepatic cells via receptor-mediated endocytosis following binding of GalNAc to ASGPR (see e.g. Nair et al., J. Am. Chem. Soc. (2014) 136(49): 16958-16961). In some embodiments, an inhibitor, e.g. a nucleic acid, is conjugated to one or more (e.g. 1, 2, 3, 4 or more) GalNAc moieties. In some embodiments, one or more GalNAc moieties may be covalently associated to the 5' or 3' end of one or more strands of a nucleic acid. In some embodiments, a nucleic acid is conjugated to a triantennary GalNAc carbohydrate moiety (such moieties are described e.g. in Nair et al., supra).

In some embodiments, an inhibitory nucleic acid according to the present disclosure comprises: (i) nucleic acid comprising the nucleotide sequence of one of SEQ ID NOs: 1 to 7155, or a nucleotide sequence having at least 75% sequence identity (e.g. one of at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity) to one of SEQ ID NOs: 1 to 7155; and (ii) a triantennary GalNAc carbohydrate moiety.

In some embodiments, the moiety is, or comprises, α-tocopherol (i.e. vitamin E). In some embodiments, a nucleic acid is conjugated to α-tocopherol. Nucleic acid-α-tocopherol conjugates have been employed for targeted delivery of nucleic acids to the liver (see e.g. Nishina et al., Mol Ther. (2008) 16(4):734-740). In some embodiments, a nucleic acid is conjugated to one or more (e.g. 1, 2, 3, 4 or more) α-tocopherol moieties. In some embodiments, one or more α-tocopherol moieties may be covalently associated to the 5' or 3' end of one or more strands of a nucleic acid.

Conjugates of biomolecules may be produced utilising 'click chemistry', as described e.g. in Nwe and Brechbiel Cancer Biother Radiopharm. (2009) 24(3):289-302 and Astakhova et al., Mol Pharm. (2018) 15(8): 2892-2899, both of which are hereby incorporated by reference in their entirety. In some embodiments, conjugation may employ akyne-azide or thio-maleimide approaches. In some embodiments, an inhibitor, e.g. nucleic acid, may be conjugated to a moiety facilitating delivery to, and/or uptake by, a cell type or tissue of interest, e.g. at the 3' and/or 5' end of one or more strands of the nucleic acid.

Inhibitors may be conjugated to one or more moieties facilitating delivery to, and/or uptake by, cell types or tissues of interest via a linker. In some embodiments, a linker may be or comprise a nucleotide sequence. The nucleotide sequence of a linker may comprise one or more modified nucleotides as described herein.

Treatment/Prevention of Disease

The inhibitors, nucleic acids, expression vectors, cells and compositions described herein find use in therapeutic and prophylactic methods.

The present invention provides methods and articles (agents and compositions) for the treatment and/or prevention of diseases through inhibition of MFAP4, GRHPR, ITFG1, ABCC4, PAK3, TRNP1, APLN, KIF20A, and/or LTB. Treatment/prevention of disease is achieved by inhibition of MFAP4, GRHPR, ITFG1, ABCC4, PAK3, TRNP1, APLN, KIF20A, and/or LTB in e.g. a cell, tissue/organ/organ system/subject.

The invention is concerned with the treatment and/or prevention of diseases which are caused and/or exacerbated by an increase in the expression/activity of one or more of MFAP4, GRHPR, ITFG1, ABCC4, PAK3, TRNP1, APLN, KIF20A, and/or LTB (and/or associated downstream factors), or diseases which are caused and/or exacerbated by a decrease in the expression/activity of one or more associated downstream factors that are downregulated by one or more of MFAP4, GRHPR, ITFG1, ABCC4, PAK3, TRNP1, APLN, KIF20A, and/or LTB.

Inhibition of one or more of MFAP4, GRHPR, ITFG1, ABCC4, PAK3, TRNP1, APLN, KIF20A, and/or LTB (genes, mRNA and/or proteins) in any of the methods described herein may be achieved using any suitable inhibitor. In some embodiments, the inhibitor is a nucleic acid, peptide, antibody, antigen-binding molecule or small molecule inhibitor, e.g. as described herein. Multiple inhibitors may be used to target any two or more of the genes/proteins.

In any method provided herein, the inhibitor may be a nucleic acid as described herein, e.g. an inhibitory nucleic acid.

The utility of the present invention extends to the treatment/prevention of any disease that would derive therapeutic/prophylactic benefit from a reduction in the level of one or more of MFAP4, GRHPR, ITFG1, ABCC4, PAK3, TRNP1, APLN, KIF20A, and/or LTB expression and/or activity.

In some embodiments, a disease to be treated/prevented may be characterised by an increase in the expression/activity of one or more of MFAP4, GRHPR, ITFG1, ABCC4, PAK3, TRNP1, APLN, KIF20A, and/or LTB (or a correlate thereof) in an organ/tissue/subject affected by the disease e.g. as compared to normal organ/tissue/subject (i.e. in the absence of the disease).

Treatment/prevention may be of a disease that is associated with an upregulation in the expression/activity of one or more of MFAP4, GRHPR, ITFG1, ABCC4, PAK3, TRNP1, APLN, KIF20A, and/or LTB (or a correlate thereof) in cells/tissue/an organ in which the symptoms of the disease manifest.

The experimental examples demonstrate that expression of MFAP4, GRHPR, ITFG1, ABCC4, PAK3, TRNP1, APLN, KIF20A, and LTB is upregulated in fibroinflammatory disorders, such as liver disease, inflammatory liver disorders, steatosis, non-alcoholic fatty liver disease (NAFLD), non-alcoholic steatohepatitis (NASH), fibrosis, cirrhosis, and hepatocellular carcinoma (HCC).

Thus, the present disclosure establishes inhibition of MFAP4, GRHPR, ITFG1, ABCC4, PAK3, TRNP1, APLN, KIF20A, or LTB as being useful for the treatment/prevention of diseases that are characterised by, e.g., NAFLD, NASH, fibrosis, and/or inflammation, e.g. of the liver or other tissues.

Aspects of the present invention are concerned with the treatment/prevention of a liver disease or condition.

Thus, in one aspect the present invention provides a method of treating or preventing a liver disease or condition, comprising inhibiting at least one of MFAP4, GRHPR, ITFG1, ABCC4, PAK3, TRNP1, APLN, KIF20A, and/or LTB. As described hereinabove, inhibition/inhibiting may refer to inhibition of the expression and/or activity of MFAP4, GRHPR, ITFG1, ABCC4, PAK3, TRNP1, APLN, KIF20A, and/or LTB and the downstream functional consequences thereof, and encompasses decreased/reduced gene and/or protein expression or decreased/reduced activity of any one of said genes/proteins.

Also provided is a method of treating or preventing a liver disease or condition, comprising administering a therapeutically or prophylactically effective amount of an inhibitor of at least one of MFAP4, GRHPR, ITFG1, ABCC4, PAK3, TRNP1, APLN, KIF20A, and/or LTB to a subject. The method may comprise administering two or more (i.e. 2, 3, 4, 5, 6, 7, 8 or 9) inhibitors that target two or more (i.e. 2, 3, 4, 5, 6, 7, 8 or 9) of MFAP4, GRHPR, ITFG1, ABCC4, PAK3, TRNP1, APLN, KIF20A, and/or LTB.

Also provided is an inhibitor of at least one of MFAP4, GRHPR, ITFG1, ABCC4, PAK3, TRNP1, APLN, KIF20A, and/or LTB for use in a method of treating or preventing a liver disease or condition.

Also provided is the use of an inhibitor of at least one of MFAP4, GRHPR, ITFG1, ABCC4, PAK3, TRNP1, APLN, KIF20A, and/or LTB in the manufacture of a medicament for use in a method of treating or preventing a liver disease or condition.

The inhibitor may be any suitable inhibitor of at least one of MFAP4, GRHPR, ITFG1, ABCC4, PAK3, TRNP1, APLN, KIF20A, and/or LTB, such as any agent described herein, e.g. nucleic acid, peptide, antibody, antigen-binding molecule or small molecule inhibitor. In some embodiments the inhibitor is an inhibitory nucleic acid, such as those described herein.

In some embodiments, the liver disease or condition to be treated/prevented is selected from the group consisting of: acute liver disease, chronic liver disease, metabolic liver disease, steatosis, liver fibrosis, primary sclerosing cholangitis (PSC), cirrhosis, mild liver fibrosis, advanced liver fibrosis, non-alcoholic fatty liver disease (NAFLD), non-alcoholic steatohepatitis (NASH), alcoholic fatty liver disease (ALFD), alcohol-related liver disease (ARLD), hepatic ischemia reperfusion injury, primary biliary cirrhosis (PBC), hepatitis, liver damage, liver injury, liver failure, metabolic syndrome, obesity, diabetes mellitus, end-stage liver disease, inflammation of the liver, lobular inflammation, and/or hepatocellular carcinoma (HCC).

In some embodiments, the liver fibrosis is a virus-induced liver fibrosis. In some embodiments, the hepatitis is an alcohol-induced hepatitis. In some embodiments, the liver damage is a drug or virus-induced liver damage.

The experimental examples of the present disclosure identify MFAP4, GRHPR, ITFG1, ABCC4, PAK3, TRNP1, APLN, KIF20A, and LTB as regulators of fibroinflammatory processes, which are moreover conserved between different tissue types.

Aspects of the present invention are concerned with the treatment/prevention of diseases in which profibrotic processes are pathologically implicated. Accordingly, in some embodiments the disease is fibrosis, or a disease characterised by fibrosis.

As used herein, "fibrosis" refers to the formation of excess fibrous connective tissue as a result of the excess deposition of extracellular matrix components, for example collagen. Fibrous connective tissue is characterised by having extracellular matrix (ECM) with a high collagen content. The collagen may be provided in strands or fibers, which may be arranged irregularly or aligned. The ECM of fibrous connective tissue may also include glycosaminoglycans.

As used herein, "excess fibrous connective tissue" refers to an amount of connective tissue at a given location (e.g. a given tissue or organ, or part of a given tissue or organ) which is greater than the amount of connective tissue present at that location in the absence of fibrosis, e.g. under normal, non-pathological conditions. As used herein, "excess deposition of ECM components" refers to a level of deposition of one or more ECM components which is greater than the level of deposition in the absence of fibrosis, e.g. under normal, non-pathological conditions.

The cellular and molecular mechanisms of fibrosis are described in Wynn, J. Pathol. (2008) 214(2): 199-210, and Wynn and Ramalingam, Nature Medicine (2012) 18:1028-1040, which are hereby incorporated by reference in their entirety.

Damage to tissues can result from various stimuli, including infections, autoimmune reactions, toxins, radiation and mechanical injury. Repair typically involves replacement of injured cells by cells of the same type, and replacement of normal parenchymal tissue with connective tissue. Repair processes become pathogenic when they are not controlled properly, resulting in substantial deposition of ECM components in which normal tissue is replaced with permanent scar tissue. In diseases such as idiopathic pulmonary fibrosis, liver cirrhosis, cardiovascular fibrosis, systemic sclerosis and nephritis, extensive tissue remodelling and fibrosis can ultimately lead to organ failure and death.

The main cellular effectors of fibrosis are myofibroblasts, which produce a collagen-rich ECM. In response to tissue injury, damaged cells and leukocytes produce pro-fibrotic factors such as TGFβ, IL-13 and PDGF, which activate fibroblasts to αSMA-expressing myofibroblasts, and recruit myofibroblasts to the site of injury. Myofibroblasts produce a large amount of ECM, and are important mediators in aiding contracture and closure of the wound. However, under conditions of persistent infection or during chronic inflammation there can be overactivation and recruitment of myofibroblasts, and thus over-production of ECM components, resulting in the formation of excess fibrous connective tissue.

Inflammatory reactions play an important part in triggering fibrosis in many different organ systems. Inflammation can lead to excess in deposition of ECM components in the affected tissues. Low-grade but persistent inflammation is also thought to contribute to the progression of fibrosis in cardiovascular disease and hypertension. In many fibrotic disorders, a persistent inflammatory trigger is crucial to upregulation of production of growth factors, proteolytic enzymes, angiogenic factors and fibrogenic cytokines, which stimulate the deposition of connective tissue elements that progressively remodel and destroy normal tissue architecture.

In some embodiments fibrosis may be triggered by pathological conditions, e.g. conditions, infections or disease states that lead to production of pro-fibrotic factors such as TGFβ1. In some embodiments, fibrosis may be caused by physical injury/stimuli, chemical injury/stimuli or environmental injury/stimuli. Physical injury/stimuli may occur during surgery, e.g. iatrogenic causes. Chemical injury/stimuli may include drug induced fibrosis, e.g. following chronic administration of drugs such as bleomycin, cyclophosphamide, amiodarone, procainamide, penicillamine, gold and nitrofurantoin (Daba et al., Saudi Med J 2004 June, 25(6): 700-6). Environmental injury/stimuli may include exposure to asbestos fibres or silica.

Fibrosis can be of any tissue/organ of the body. In some embodiments, fibrosis is of the heart, kidney, liver, lung, skeletal muscle, blood vessels, eye, skin, pancreas, bowel, small intestine, large intestine, colon, brain, or bone marrow. In some embodiments, the fibrosis is of the liver. In some embodiments, the fibrosis is of the heart, lung or kidney. Fibrosis may also occur in multiple tissues/organs at once.

Thus, the present invention provides methods and articles (agents and compositions) for the treatment and/or prevention of diseases characterised by fibrosis through inhibition of MFAP4, GRHPR, ITFG1, ABCC4, PAK3, TRNP1, APLN, KIF20A, and/or LTB.

Thus, in one aspect the present invention provides a method of treating or preventing a disease characterised by fibrosis, comprising inhibiting at least one of MFAP4, GRHPR, ITFG1, ABCC4, PAK3, TRNP1, APLN, KIF20A, and/or LTB.

Also provided is a method of treating or preventing a disease characterised by fibrosis, comprising administering a therapeutically or prophylactically effective amount of an inhibitor of at least one of MFAP4, GRHPR, ITFG1, ABCC4, PAK3, TRNP1, APLN, KIF20A, and/or LTB to a subject. The method may comprise administering two or more (i.e. 2, 3, 4, 5, 6, 7, 8 or 9) inhibitors that target two or more (i.e. 2, 3, 4, 5, 6, 7, 8 or 9) of MFAP4, GRHPR, ITFG1, ABCC4, PAK3, TRNP1, APLN, KIF20A, and/or LTB.

Also provided is an inhibitor of at least one of MFAP4, GRHPR, ITFG1, ABCC4, PAK3, TRNP1, APLN, KIF20A, and/or LTB for use in a method of treating or preventing a disease characterised by fibrosis.

Also provided is the use of an inhibitor of at least one of MFAP4, GRHPR, ITFG1, ABCC4, PAK3, TRNP1, APLN, KIF20A, and/or LTB in the manufacture of a medicament for use in a method of treating or preventing a disease characterised by fibrosis.

A "disease characterised by fibrosis" refers to a disease in which fibrosis and/or profibrotic processes are pathologically implicated. A "disease characterised by fibrosis" may be fibrosis, e.g. of any cell, tissue or organ.

Diseases characterised by fibrosis include but are not limited to: respiratory conditions such as pulmonary fibrosis, cystic fibrosis, idiopathic pulmonary fibrosis, progressive massive fibrosis, scleroderma, obliterative bronchiolitis, Hermansky-Pudlak syndrome, asbestosis, silicosis, chronic pulmonary hypertension, AIDS associated pulmonary hypertension, sarcoidosis, tumor stroma in lung disease, and asthma; chronic liver disease, cirrhosis, non-alcoholic fatty liver disease (NAFLD), non-alcoholic steatohepatitis (NASH), primary biliary cirrhosis (PBC), schistosomal liver disease, cardiovascular conditions such as hypertrophic cardiomyopathy (HCM), dilated cardiomyopathy (DCM), fibrosis of the atrium, atrial fibrillation, fibrosis of the ventricle, ventricular fibrillation, myocardial fibrosis, Brugada syndrome, myocarditis, endomyocardial fibrosis, myocardial infarction, fibrotic vascular disease, hypertensive heart disease, arrhythmogenic right ventricular cardiomyopathy (ARVC), tubulointerstitial and glomerular fibrosis, atherosclerosis, varicose veins, cerebral infarcts; neurological conditions such as gliosis and Alzheimer's disease; muscular dystrophy such as Duchenne muscular dystrophy (DMD) or Becker's muscular dystrophy (BMD); gastrointestinal conditions such as Crohn's disease, microscopic colitis and primary sclerosing cholangitis (PSC); skin conditions such as scleroderma, nephrogenic systemic fibrosis and cutis keloid; arthrofibrosis; Dupuytren's contracture; mediastinal fibrosis; retroperitoneal fibrosis; myelofibrosis; Peyronie's disease; adhesive capsulitis; kidney disease (e.g., renal fibrosis, nephritic syndrome, Alport's syndrome, HIV associated nephropathy, polycystic kidney disease, Fabry's disease, diabetic nephropathy, chronic glomerulonephritis, nephritis associated with systemic lupus); progressive systemic sclerosis (PSS); chronic graft versus host disease; diseases of the eye such as Grave's opthalmopathy, epiretinal fibrosis, retinal fibrosis, subretinal fibrosis (e.g. associated with macular degeneration (e.g. wet age-related macular degeneration (AMD)), diabetic retinopathy, glaucoma, corneal fibrosis, post-surgical fibrosis (e.g. of the posterior capsule following cataract surgery, or of the bleb following trabeculectomy for glaucoma), conjunctival fibrosis, subconjunctival fibrosis; arthritis; fibrotic pre-neoplastic and fibrotic neoplastic disease; and fibrosis induced by chemical or environmental insult (e.g., cancer chemotherapy, pesticides, radiation/cancer radiotherapy).

It will be appreciated that many of the diseases/conditions recited in the preceding paragraph are interrelated. For example, fibrosis of the ventricle may occur post myocardial infarction, and is associated with DCM, HCM and myocarditis.

Fibrosis can lead directly or indirectly to, and/or increase susceptibility to development of, diseases. For example, more than 80% of hepatocellular carcinomas (HCCs) develop in fibrotic or cirrhotic livers (Affo et al. 2016, Annu Rev Pathol.), suggesting an important role for liver fibrosis in the premalignant environment (PME) of the liver.

Accordingly, the present invention also finds use in methods for the treatment and prevention of diseases associated with fibrosis, and/or for which fibrosis is a risk factor. In some embodiments, the disease associated with fibrosis, or for which fibrosis is a risk factor, is a cancer, e.g. cancer of the liver (e.g. hepatocellular carcinoma).

In some embodiments, the fibrosis to be treated/prevented according to the present invention may be of fibrosis that is associated with an upregulation of MFAP4, GRHPR, ITFG1, ABCC4, PAK3, TRNP1, APLN, KIF20A, and/or LTB expression and/or activity, e.g. in cells/tissue/an organ in which the fibrosis occurs or may occur.

The therapy may be effective to inhibit development (delay/prevent) of the fibrosis, or of progression (e.g. worsening) of the fibrosis. In some embodiments therapy may lead to an improvement in the disease, e.g. a reduction in the symptoms of fibrosis. Prevention of fibrosis may refer to prevention of a worsening of the condition or prevention of the development of fibrosis, e.g. preventing an early stage fibrosis (e.g. inflammation, steatosis, NAFLD) developing to a later stage (e.g. fibrosis, cirrhosis, HCC).

Aspects of the present invention are concerned with the treatment/prevention of diseases in which proinflammatory processes are pathologically implicated. Inflammation is reviewed e.g. in Chen et al., Oncotarget. (2018) 9(6): 7204-7218, which is hereby incorporated by reference in its entirety. Inflammation refers to the bodily response to cellular/tissue injury, and is characterised by edema, erythema (redness), heat, pain, and loss of function (stiffness and immobility) resulting from local immune, vascular and inflammatory cell responses to infection or injury. The injury may result from e.g. of physical (e.g. mechanical) or chemical insult, trauma, infection, cancer or overactive/aberrant immune responses (e.g. autoimmune disease). Inflammation forms part of the innate immune response, and plays an important physiological role in wound healing and the control of infection, and contributes to the restoration of tissue homeostasis.

However, many diseases are associated with an overactive inflammatory response (i.e. excessive inflammation and/or aberrantly activated inflammation), and/or chronic (prolonged) inflammation. Herein, excessive and/or chronic inflammation may be referred to as "pathological inflammation". Pathological inflammation may refer to inflammation which is implicated in (i.e. which positively contributes to) the pathology of a disease.

In some embodiments, the disease to be treated/prevented in accordance with the present invention is a disease characterised by chronic inflammation. In some embodiments, the disease to be treated/prevented is a disease characterised by an overactive inflammatory response.

In some embodiments, the treatment/prevention of chronic inflammation or an overactive inflammatory immune response associated with a chronic infection, cancer, autoimmune disease, degenerative disease or allergic disease is contemplated.

Pathological inflammation which is "associated with" a given disease (e.g. a chronic infection, a cancer, an autoimmune disease, a degenerative disease or an allergic disease) may refer to pathological inflammation caused by, initiated by and/or which is a consequence of the disease. Pathological inflammation associated with a given disease may be concurrent with the disease.

Chronic inflammation generally refers to inflammation lasting for prolonged periods of time, e.g. from months to years. Chronic inflammation can result e.g. from failure to properly control/eliminate an infectious agent causing inflammation (i.e. chronic infection), prolonged/repeated exposure to physical/chemical insult, prolonged/repeated exposure to an allergen (allergy), and autoimmune disease.

The chronic inflammation, overactive inflammatory immune response, chronic infection, cancer, autoimmune disease, degenerative disease or allergic disease may affect any tissue/organ of the body, e.g. the heart, kidney, liver, lung, skeletal muscle, blood vessels, eye, skin, pancreas, bowel, small intestine, large intestine, colon, brain, or bone marrow, or multiple tissues/organs at once.

An overactive inflammatory immune response generally refers to an inflammatory immune response that is excessive, and/or which has been activated inappropriately (i.e. an inflammatory immune response which is aberrant). An excessive inflammatory immune response refers to an inflammatory immune response which is greater than the response required for restoration of tissue homeostasis following injury to tissue (e.g. as a result of physical or chemical insult or infection). Aberrant inflammatory immune responses include inflammatory immune responses resulting from autoimmunity and allergy.

Chronic infections include persistent/unresolved infection by any infectious agent, e.g. chronic viral, bacterial, fungal and protozoal infections. Chronic viral infections may be caused e.g. by infection with human immunodeficiency viruses (HIVs), hepatitis B virus (HBV), hepatitis C virus (HCV), Epstein-Barr Virus (EBV), measles virus (MV), cytomegalovirus (CMV), human T-cell leukemia viruses (HTLVs), human herpesviruses (HHVs), herpes simplex viruses (HSVs), Varicella-Zoster virus (VZV), human papovaviruses (e.g. JC virus, BK virus), adenoviruses (AdVs), paroviruses or human papillomaviruses (HPVs). Chronic bacterial infections may be caused e.g. by infection with *Mycobacterium tuberculosis Helicobacter pylori*, *Salmonella Typhi, Treponema pallidum, Pseudomonas aeruginosa, Escherichia coli, Staphylococcus aureus*, Hemophilus *influenza* or *Mycobacterium leprae*. Chronic fungal infections may be caused e.g. by infection with *Candida* spp or *Aspergillus*. Chronic protozoal infections may be caused e.g. by infection with *Plasmodium* spp., *Babesia* spp., Giardia spp., *Leishmania* spp., *Trypanosoma* spp. or *Toxoplasma* spp.

A cancer may be any cancer. As used herein, cancers include any unwanted cell proliferation (or any disease manifesting itself by unwanted cell proliferation), neoplasm or tumor. The cancer may be benign or malignant and may be primary or secondary (metastatic). A neoplasm or tumor may be any abnormal growth or proliferation of cells and may be located in any tissue. The cancer may be of tissues/cells derived from e.g. the adrenal gland, adrenal medulla, anus, appendix, bladder, blood, bone, bone marrow, brain, breast, cecum, central nervous system (including or excluding the brain) cerebellum, cervix, colon, duodenum, endometrium, epithelial cells (e.g. renal epithelia), gallbladder, oesophagus, glial cells, heart, ileum, jejunum, kidney, lacrimal glad, larynx, liver, lung, lymph, lymph node, lymphoblast, maxilla, mediastinum, mesentery, myometrium, nasopharynx, omentum, oral cavity, ovary, pancreas, parotid gland, peripheral nervous system, peritoneum, pleura, prostate, salivary gland, sigmoid colon, skin, small intestine, soft tissues, spleen, stomach, testis, thymus, thyroid gland, tongue, tonsil, trachea, uterus, vulva, and/or white blood cells.

An autoimmune disease may be selected from: diabetes mellitus type 1, diabetes mellitus type 2, coeliac disease, Graves' disease, inflammatory bowel disease (e.g. Crohn's disease), multiple sclerosis, psoriasis, rheumatoid arthritis, and systemic lupus erythematosus.

Degenerative diseases are characterised by deterioration of cell/tissue/organ condition or function over time. Proinflammatory and profibrotic processes are implicated in the pathology of many degenerative diseases.

Degenerative disease include e.g. Alzheimer's disease, amyotrophic lateral sclerosis, cancers, Charcot-Marie-Tooth disease, chronic traumatic encephalopathy, cystic fibrosis, degenerative Leigh syndrome, Ehlers-Danlos syndrome, fibrodysplasia ossificans progressiva, Friedreich's ataxia, frontotemporal dementia, cardiovascular diseases (e.g. atherosclerotic cardiovascular disease (e.g. coronary artery disease, aortic stenosis), myocardial infarction, pulmonary arterial hypertension), Huntington's disease, infantile neuroaxonal dystrophy, keratoconus, keratoglobus, leukodystrophies, macular degeneration, Marfan's syndrome, mitochondrial myopathies, mitochondrial DNA depletion syndrome, multiple sclerosis, multiple system atrophy, muscular dystrophies, neuronal ceroid lipofuscinosis, Niemann-Pick disease, osteoarthritis, osteoporosis, Parkinson's disease, pulmonary arterial hypertension, all prion diseases (Creutzfeldt-Jakob disease, fatal familial insomnia etc.), progressive supranuclear palsy, retinitis pigmentosa, rheumatoid arthritis, Sandhoff Disease, spinal muscular atrophy, subacute sclerosing panencephalitis, Tay-Sachs disease and vascular dementia.

An allergic disease may be selected from allergic asthma, allergic rhinitis, food allergy and atopic dermatitis.

In some embodiments the chronic inflammation, overactive inflammatory immune response, chronic infection, cancer, autoimmune disease or allergic disease may be of: an organ of the cardiovascular system, e.g. of the heart or blood vessels; an organ of the gastrointestinal system, e.g. of the liver, bowel, small intestine, large intestine, colon, or pancreas; an organ of the respiratory system, e.g. the lung; the skin; an organ of the nervous system, e.g. the brain; an organ of the urinary system, e.g. the kidneys; or an organ of the musculoskeletal system, e.g. muscle tissue.

Pathological inflammation often leads to fibrosis—see e.g. Mack, Matrix Biol. (2018) 68-69:106-121 and Suthahar et al., Curr Heart Fail Rep. (2017) 14(4): 235-250, both of which are hereby incorporated by reference in their entirety.

The present invention also finds use in methods for the treatment and prevention of diseases associated with pathological inflammation, and/or for which pathological inflammation is a risk factor. In some embodiments, the disease associated with pathological inflammation, or for which pathological inflammation is a risk factor, is fibrosis or a disease characterised by fibrosis.

In some embodiments, the pathological inflammation to be treated/prevented according to the present invention may be of pathological inflammation that is associated with an upregulation of expression and/or activity of one or more of MFAP4, GRHPR, ITFG1, ABCC4, PAK3, TRNP1, APLN, KIF20A, and/or LTB, e.g. in cells/tissue/an organ in which the pathological inflammation occurs or may occur.

The therapy may be effective to inhibit development (delay/prevent) of the pathological inflammation, or of progression (e.g. worsening) of the pathological inflammation. In some embodiments therapy may lead to an improvement in the disease, e.g. a reduction in the symptoms of pathological inflammation. Prevention of pathological inflammation may refer to prevention of a worsening of the condition or prevention of the development of pathological inflammation, e.g. preventing an early stage pathological inflammation developing to a later stage.

Therapeutic/prophylactic intervention in accordance with the present invention may be employed in the context of additional treatment for the relevant disease. That is, expression/activity of one or more of MFAP4, GRHPR, ITFG1, ABCC4, PAK3, TRNP1, APLN, KIF20A, and/or LTB may be inhibited in a subject (e.g. by treatment with a suitable inhibitor such as those described herein) that is also receiving/has received/will receive further therapeutic/prophylactic intervention for the treatment/prevention of the disease.

The experimental examples show that proliferation, expansion and regeneration of liver and lung cells/tissue can be achieved via inhibition of one or more of MFAP4, GRHPR, ITFG1, ABCC4, PAK3, TRNP1, APLN, KIF20A, and/or LTB.

In accordance with various aspects of the present invention, a method of treating and/or preventing a disease according to the present invention may comprise one or more of the following:

Reducing the level of gene/protein expression of one or more of MFAP4, GRHPR, ITFG1, ABCC4, PAK3, TRNP1, APLN, KIF20A, and/or LTB;

Reducing the level of activity of one or more of MFAP4, GRHPR, ITFG1, ABCC4, PAK3, TRNP1, APLN, KIF20A, and/or LTB;

Reducing the level of a correlate of fibrosis (e.g. a collagen, αSMA, periostin, fibronectin, CTGF, vimentin or lumican);

Reducing gene/protein expression of a pro-fibrotic factor (e.g. a collagen, αSMA, periostin, fibronectin, CTGF, vimentin or lumican);

Reducing the number/proportion of myofibroblasts;

Reducing the level of a correlate of pathological inflammation;

Reducing gene/protein expression of a pro-inflammatory factor;

Reducing the number/proportion of myofibroblasts;

Increasing the function of an organ/tissue affected by the disease;

Stimulating/increasing proliferation of a cell affected by the disease;

Stimulating/increasing expansion of a cell affected by the disease;

Stimulating/increasing regeneration of a cell affected by the disease;

Stimulating/increasing proliferation of a myoblast;

Stimulating/increasing expansion of a myoblast;

Stimulating/increasing regeneration of a myoblast;

Increasing the number/proportion of health myoblasts;

Stimulating/increasing regeneration of an organ/tissue affected by the disease;

Stimulating/increasing proliferation and/or expansion of a cell in an organ/tissue affected by the disease;

Stimulating/increasing proliferation and/or expansion of a hepatocyte, e.g. that is affected by the disease or that is in an organ/tissue affected by the disease;

Stimulating/increasing regeneration of liver tissue;

Stimulating/increasing regeneration of lung tissue;

Stimulating/increasing regeneration of the liver;

Stimulating/increasing regeneration of the lung;

Increasing function of an organ/tissue affected by the disease;

Increasing liver function;

Increasing lung function;

Increasing wound healing in an organ/tissue affected by the disease;

Increasing wound healing in liver tissue;

Increasing wound healing in lung tissue;

Protecting an organ/tissue affected by the disease;

Protecting a liver/liver tissue affected by the disease;

Protecting a lung/lung tissue affected by the disease;

Increasing the survival of a subject having the disease;

Reducing the number/proportion of macrophages in an organ/tissue affected by the disease; and/or Reducing the number/proportion of monocytes in an organ/tissue affected by the disease;

Methods for treating a subject are provided herein.

The disclosure teaches a method of treating a condition or disease in a subject, the method comprising administering to the subject an inhibitor of a gene or corresponding gene product associated with organ regeneration for a sufficient time and under conditions to treat the condition or disease in the subject.

Disclosed herein is a method of treating a liver condition or disease in a subject, the method comprising administering to the subject an inhibitor of a gene or corresponding gene product associated with organ regeneration for a sufficient time and under conditions to treat the liver condition or disease in the subject.

A "gene associated with organ regeneration" as used herein may refer to one or more of MFAP4, GRHPR, ITFG1, ABCC4, PAK3, TRNP1, APLN, KIF20A, and/or LTB genes. A "corresponding gene product associated with organ regeneration" as used herein may refer to an mRNA encoded by one or more genes above, or a MFAP4, GRHPR, ITFG1, ABCC4, PAK3, TRNP1, APLN, KIF20A, and/or LTB protein.

In one embodiment, a subject herein is suffering from a liver condition or disease, as described herein. The methods described herein may comprise preventing or treating the liver condition or disease.

In one embodiment, a subject herein is suffering from a lung condition or disease. The lung condition or disease may be a cigarette or viral-induced lung condition or disease. The lung condition or disease may be lung damage or fibrosis. The method may comprise preventing or treating the lung condition or disease.

Disclosed herein is a method of protecting a subject from liver damage or a disease associated with fibrosis, the method comprising administering to the subject an inhibitor of a gene or corresponding gene product associated with organ regeneration for a sufficient time and under conditions to protect the subject from liver damage. The inhibitor may be one described herein. A gene/corresponding gene product associated with organ regeneration may be one or more of MFAP4, GRHPR, ITFG1, ABCC4, PAK3, TRNP1, APLN, KIF20A, and/or LTB.

Disclosed herein is an inhibitor of a gene or corresponding gene product associated with organ regeneration for use in preventing or treating a liver condition or disease in the subject. In one embodiment, the inhibitor is capable of stimulating or increasing proliferation of hepatocytes in the subject.

Disclosed herein is the use of an inhibitor of a gene or corresponding gene product associated with organ regeneration in the manufacture of a medicament for preventing or treating a liver condition or disease in the subject.

Disclosed herein is a method of enhancing cell function in a subject, the method comprising administering to the subject an inhibitor of a gene or corresponding gene product associated with organ regeneration for a sufficient time and under conditions to enhance cell function in the subject. "Enhancing cell function" refers to improving the endogenous activity of a cell, e.g. signalling, proliferation, expansion. Function of a cell may be enhanced starting from a healthy state, or from a diseased/impaired state.

The method may comprise improving the robustness of the cell under diseased condition. The term robustness refers to being able to survive under diseased condition.

Disclosed herein is a method of enhancing cell viability in a subject, the method comprising administering to the subject an inhibitor of a gene or corresponding gene product associated with organ regeneration for a sufficient time and under conditions to enhance cell viability in the subject, e.g. in inhibitor described herein.

The present disclosure teaches a method of stimulating or increasing proliferation and/or regeneration of a cell in a subject, the method comprising administering to the subject an inhibitor of a gene or corresponding gene product associated with organ regeneration for a sufficient time and under conditions to stimulate or increase proliferation of the cell in the subject.

In one embodiment, the method further increases the robustness of the cell under diseased conditions in the subject.

In one embodiment, the gene associated with organ regeneration is identified by knocking down the gene in a hepatocyte of an animal model and detecting proliferation and/or regeneration of the hepatocyte in the animal model.

The gene associated with organ regeneration is selected from the group consisting of Microfibril Associated Protein 4 (Mfap4), Glyoxylate and Hydroxypyruvate Reductase (Grhpr), Integrin Alpha FG-GAP Repeat Containing 1 (Itfg1), ATP binding cassette subfamily C member 4 (ABCC4), p21 (RAC1) activated kinase 3 (PAK3), TMF1 regulated nuclear protein 1 (TRNP1), Apelin (APLN), Kindesin Family Member 20A (KIF20A) and Lymphotoxin beta (LTB).

A "gene product" is a biopolymeric product that is expressed or produced by a gene. A gene product may be, for example, an unspliced RNA, an mRNA, a splice variant mRNA, a polypeptide, a post-translationally modified polypeptide, a splice variant polypeptide etc. Also encompassed by this term is biopolymeric products that are made using an RNA gene product as a template (i.e. cDNA of the RNA). A gene product may be made enzymatically, recombinantly, chemically, or within a cell to which the gene is native. In many embodiments, if the gene product is proteinaceous, it exhibits a biological activity. In many embodiments, if the gene product is a nucleic acid, it can be translated into a proteinaceous gene product that exhibits a biological activity.

Disclosed herein is an in vitro or in vivo method for reducing gene and/or protein expression of one or more of MFAP4, GRHPR, ITFG1, ABCC4, PAK3, TRNP1, APLN, KIF20A, and/or LTB in a cell, comprising introducing an inhibitor described herein into the cell. In some embodiments, the inhibitor is an inhibitory nucleic acid as described herein.

Disclosed herein is a method of regenerating liver tissue in vitro or in vivo, the method comprising inhibiting at least one of MFAP4, GRHPR, ITFG1, ABCC4, PAK3, TRNP1, APLN, KIF20A, and/or LTB in a cell of the tissue, e.g. using an inhibitor described herein.

Disclosed herein is a method for preventing age-dependent decline in the regenerative capacity of a hepatocyte, the method comprising inhibiting at least one of MFAP4, GRHPR, ITFG1, ABCC4, PAK3, TRNP1, APLN, KIF20A, and/or LTB in a cell of the tissue, e.g. using an inhibitor described herein.

The term "treating" as used herein may refer to (1) preventing or delaying the appearance of one or more symptoms of the disorder; (2) inhibiting the development of the disorder or one or more symptoms of the disorder; (3) relieving the disorder, i.e., causing regression of the disorder or at least one or more symptoms of the disorder; and/or (4)

causing a decrease in the severity of one or more symptoms of the disorder. The term "treating" may refer to regeneration of the tissue/organ in question, or preventing a disease/condition from progressing to a later, more severe stage.

The term "administering" refers to contacting, applying, injecting, transfusing or providing an inhibitor as referred to herein to a subject.

The term "subject" as used throughout the specification is to be understood to mean a human or may be a domestic or companion animal. While it is particularly contemplated that the methods of the invention are for treatment of humans, they are also applicable to veterinary treatments, including treatment of companion animals such as dogs and cats, and domestic animals such as horses, cattle and sheep, or zoo animals such as primates, felids, canids, bovids, and ungulates. The "subject" may include a person, a patient or individual, and may be of any age or gender.

The patient may have a disease described herein. A subject may have been diagnosed with a disease requiring treatment, may be suspected of having such a disease, or may be at risk from developing a disease.

In embodiments according to the present invention the subject is preferably a human subject. In embodiments according to the present invention, a subject may be selected for treatment according to the methods based on characterisation for certain markers of a disease described herein.

In some embodiments, any method disclosed herein comprises administering an inhibitor according to the present disclosure into a subject, organ, tissue or cell. The organ, tissue or cell may be in vivo or in vitro. Any method described herein may be performed in vivo or in vitro.

Aspects and embodiments of the present invention concern detection of expression of one or more of MFAP4, GRHPR, ITFG1, ABCC4, PAK3, TRNP1, APLN, KIF20A, and/or LTB (gene and/or protein expression) and/or activity in a cell/tissue/organ of a subject, e.g. as determined by analysis of a cell/tissue/organ of a subject, e.g. in a sample obtained from the subject (such as an in vitro cell/tissue/organ/sample).

Disclosed herein is a method of detecting a liver condition or disease in a subject, the method comprising detecting in a sample the level of one or more biomarkers associated with liver regeneration, wherein a change in the level of the one or more biomarkers as compared to a reference indicates that the subject is suffering from a liver condition or disease. The one or more biomarkers may be one or more of MFAP4, GRHPR, ITFG1, ABCC4, PAK3, TRNP1, APLN, KIF20A, and/or LTB.

Upregulated expression and/or activity of one or more of MFAP4, GRHPR, ITFG1, ABCC4, PAK3, TRNP1, APLN, KIF20A, and/or LTB may identify a subject as a subject to be treated with an inhibitor of at least one of those genes/proteins in accordance with the present invention.

Upregulated expression/activity of one or more of MFAP4, GRHPR, ITFG1, ABCC4, PAK3, TRNP1, APLN, KIF20A, and/or LTB refers to a level of expression/activity that is greater than would be expected for a cell/tissue of a given type. Gene or protein expression and activity can be analysed as described herein.

Upregulation may be determined by measuring the level of expression/activity of one or more of MFAP4, GRHPR, ITFG1, ABCC4, PAK3, TRNP1, APLN, KIF20A, and/or LTB in a cell/tissue. Comparison may be made between the level of expression/activity in a cell or tissue sample from a subject and a reference level of expression/activity, e.g. a value/range of values representing a normal level of expression/activity for the same or corresponding cell/tissue type.

In some embodiments reference levels may be determined by detecting expression/activity of one or more of MFAP4, GRHPR, ITFG1, ABCC4, PAK3, TRNP1, APLN, KIF20A, and/or LTB in a control sample, e.g. in corresponding cells or tissue from a healthy subject or from healthy tissue of the same subject. In some embodiments reference levels may be obtained from a standard curve or data set.

A sample obtained from a subject may be of any kind. A biological sample may be taken from any tissue or bodily fluid, e.g. a blood sample, blood-derived sample, serum sample, lymph sample, semen sample, saliva sample, synovial fluid sample. A blood-derived sample may be a selected fraction of a patient's blood, e.g. a selected cell-containing fraction or a plasma or serum fraction. A sample may comprise a tissue sample or biopsy; or cells isolated from a subject. Samples may be collected by known techniques, such as biopsy or needle aspirate. Samples may be stored and/or processed for subsequent determination of the level of expression/activity of one or more of MFAP4, GRHPR, ITFG1, ABCC4, PAK3, TRNP1, APLN, KIF20A, and/or LTB.

In some preferred embodiments a sample may be a tissue sample, e.g. biopsy, taken from a tissue/organ affected by a disease described herein. A sample may contain cells.

A subject may be selected for therapy/prophylaxis in accordance with the present invention based on determination that the subject has an upregulated level of expression/activity of one or more of MFAP4, GRHPR, ITFG1, ABCC4, PAK3, TRNP1, APLN, KIF20A, and/or LTB. Upregulated expression/activity of said genes/proteins may serve as a marker of a disease suitable for treatment in accordance with the present invention.

Following selection, a subject may be treated to inhibit expression and/or activity of one or more of MFAP4, GRHPR, ITFG1, ABCC4, PAK3, TRNP1, APLN, KIF20A, and/or LTB, e.g. by administration of an inhibitor of at least one of MFAP4, GRHPR, ITFG1, ABCC4, PAK3, TRNP1, APLN, KIF20A, and/or LTB (e.g. that has an upregulated level of expression/activity).

Detection of upregulation of expression/activity of one or more of MFAP4, GRHPR, ITFG1, ABCC4, PAK3, TRNP1, APLN, KIF20A, and/or LTB may also be used in a method of diagnosing a disease described herein, identifying a subject at risk of developing a disease described herein, and in methods of prognosing a subject's response to inhibition of one or more of MFAP4, GRHPR, ITFG1, ABCC4, PAK3, TRNP1, APLN, KIF20A, and/or LTB (e.g. via treatment with an inhibitor targeting one or more of said genes/proteins).

In some embodiments a subject may be suspected of having or suffering from a disease, e.g. based on the presence of other symptoms indicative of the disease in the subject's body or in selected cells/tissues of the subject's body, or be considered at risk of developing the disease, e.g. because of genetic predisposition or exposure to environmental conditions, known to be risk factors for the disease. Determination of upregulation of expression/activity of one or more of MFAP4, GRHPR, ITFG1, ABCC4, PAK3, TRNP1, APLN, KIF20A, and/or LTB may confirm a diagnosis or suspected diagnosis, or may confirm that the subject is at risk of developing the disease. The determination may also diagnose a disease or predisposition as one suitable for treatment with an inhibitor of one or more of MFAP4, GRHPR, ITFG1, ABCC4, PAK3, TRNP1, APLN, KIF20A, and/or LTB.

As such, a method of providing a prognosis for a subject having, or suspected of having a disease may be provided, the method comprising determining whether expression/activity of one or more of MFAP4, GRHPR, ITFG1, ABCC4, PAK3, TRNP1, APLN, KIF20A, and/or LTB is upregulated in a sample obtained from the subject and, based on the determination, providing a prognosis for treatment of the subject with a inhibitor of one or more of MFAP4, GRHPR, ITFG1, ABCC4, PAK3, TRNP1, APLN, KIF20A, and/or LTB.

The method may further comprise the step of selecting the subject for treatment with an inhibitor of one or more of MFAP4, GRHPR, ITFG1, ABCC4, PAK3, TRNP1, APLN, KIF20A, and/or LTB, and/or administering an inhibitor of one or more of MFAP4, GRHPR, ITFG1, ABCC4, PAK3, TRNP1, APLN, KIF20A, and/or LTB to the subject in order to provide a treatment for a disease described herein in the subject or to prevent development or progression of a disease described herein in the subject.

Methods of diagnosis or prognosis may be performed in vitro on a sample obtained from a subject, or following processing of a sample obtained from a subject. Once the sample is collected, the patient is not required to be present for the in vitro method of diagnosis or prognosis to be performed and therefore the method may be one which is not practised on the human or animal body. The sample obtained from a subject may be of any kind, as described herein above.

Other diagnostic or prognostic tests may be used in conjunction with those described here to enhance the accuracy of the diagnosis or prognosis or to confirm a result obtained using the tests described herein.

The terms "therapeutically effective amount" and "effective amount" are used interchangeably and refer to an amount of a compound that is sufficient to effect treatment as defined below, when administered to a patient (e.g., a human) in need of such treatment in one or more doses. The therapeutically effective amount will vary depending upon the patient, the disease being treated, the weight and/or age of the patient, the severity of the disease, the nature of the agent, or the manner of administration as determined by a qualified prescriber or care giver. Examples of the techniques and protocols mentioned above can be found in Remington's Pharmaceutical Sciences, 20th Edition, 2000, pub. Lippincott, Williams & Wilkins.

Multiple doses of the agent may be provided. One or more, or each, of the doses may be accompanied by simultaneous or sequential administration of another therapeutic agent.

Multiple doses may be separated by a predetermined time interval, which may be selected to be one of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, or 31 days, or 1, 2, 3, 4, 5, or 6 months. By way of example, doses may be given once every 7, 14, 21 or 28 days (plus or minus 3, 2, or 1 days).

In therapeutic applications, inhibitors for use as described herein are preferably formulated as a medicament or pharmaceutical together with one or more other pharmaceutically acceptable ingredients well known to those skilled in the art, including, but not limited to, pharmaceutically acceptable carriers, adjuvants, excipients, diluents, fillers, buffers, preservatives, anti-oxidants, lubricants, stabilisers, solubilisers, surfactants (e.g., wetting agents), masking agents, colouring agents, flavouring agents, and sweetening agents.

As used herein, "pharmaceutically acceptable carrier" includes excipients or agents such as solvents, diluents, dispersion media, coatings, antibacterial and antifungal agents, isotonic and absorption delaying agents and the like that are not deleterious to the disclosed compound or use thereof. The use of such carriers and agents to prepare compositions of pharmaceutically active substances is well known in the art (see, e.g., Remington's Pharmaceutical Sciences, Mace Publishing Co., Philadelphia, Pa. 17th Ed. (1985); and Modern Pharmaceutics, Marcel Dekker, Inc. 3rd Ed. (G. S. Banker & C. T. Rhodes, Eds.). Each carrier, adjuvant, excipient, etc. must also be "acceptable" in the sense of being compatible with the other ingredients of the formulation.

Suitable carriers, adjuvants, excipients, etc. can be found in standard pharmaceutical texts, for example, Remington's Pharmaceutical Sciences, 18th edition, Mack Publishing Company, Easton, Pa., 1990; and Handbook of Pharmaceutical Excipients, 2nd edition, 1994.

The formulations may be prepared by any methods well known in the art of pharmacy. Such methods include the step of bringing into association the active compound with a carrier which constitutes one or more accessory ingredients. In general, the formulations are prepared by uniformly and intimately bringing into association the active compound with carriers (e.g., liquid carriers, finely divided solid carrier, etc.), and then shaping the product, if necessary.

The formulations may be prepared for topical, parenteral, systemic, intravenous, intra-arterial, intramuscular, intrathecal, intraocular, intra-conjunctival, subcutaneous, oral or transdermal routes of administration which may include injection. Injectable formulations may comprise the selected agent in a sterile or isotonic medium. The formulation and mode of administration may be selected according to the agent and disease to be treated/prevented.

Disclosed herein is a method of screening for an inhibitor of a gene or corresponding gene product associated with organ regeneration by: a) contacting the gene or corresponding gene product with a chemical compound library, and b) identifying a chemical compound within the library that is binds to the gene or corresponding gene product to inhibit the expression or function of the gene or corresponding gene product.

Also provided herein are reporter cells lines for screening of small compound inhibitors for a gene or corresponding gene product associated with cell regeneration.

Numbered Paragraphs

1. A method of stimulating or increasing proliferation and/or regeneration of a cell in a subject, the method comprising administering to the subject an inhibitor of a gene or corresponding gene product associated with organ regeneration for a sufficient time and under conditions to stimulate or increase proliferation of the cell in the subject.

2. The method of paragraph 1, wherein the method increases the robustness of the cell under diseased conditions in the subject.

3. The method of paragraph 1, wherein the gene associated with organ regeneration is identified by knocking down the gene in a hepatocyte of an animal model and detecting proliferation and/or regeneration of the hepatocyte in the animal model.

4. The method of paragraph 2, wherein the gene associated with organ regeneration is selected from the group consisting of Microfibril Associated Protein 4 (Mfap4), Glyoxylate and Hydroxypyruvate Reductase (Grhpr), Integrin Alpha FG-GAP Repeat Containing 1 (Itfg1), ATP binding cassette subfamily C member 4 (ABCC4), p21 (RAC1) activated kinase 3 (PAK3), TMF1 regulated nuclear protein 1 (TRNP1), Apelin (APLN), Kindesin Family Member 20A (KIF20A) and Lymphotoxin beta (LTB).

5. The method of paragraph 1, wherein the inhibitor is a nucleic acid, peptide, antibody or small molecule inhibitor.

6. The method of paragraph 5, wherein the inhibitor is a nucleic acid inhibitor comprising or encoding an RNAi agent having at least 70%, 80%, 90% or 95% sequence identity to an RNA sequence listed in any of Tables 1-14 or an RNAi agent that hybridizes to the complement of an RNA sequence listed in any of Tables 1-14 under stringency conditions.

7. The method of paragraph 1, wherein the subject is suffering from a liver condition or disease.

8. The method of paragraph 7, wherein the liver condition or disease is selected from the group consisting of acute liver disease, chronic liver disease, metabolic liver disease, steatosis, liver fibrosis, primary sclerosing cholangitis (PSC), cirrhosis, liver fibrosis, non-alcoholic fatty liver disease (NAFLD), non-alcoholic steatohepatitis (NASH), hepatic ischemia reperfusion injury, primary biliary cirrhosis (PBC), hepatitis and liver damage.

9. The method of paragraph 7, wherein the method comprises preventing or treating the liver condition or disease.

10. A method of enhancing cell function in a subject, the method comprising administering to the subject an inhibitor of a gene or corresponding gene product associated with organ regeneration for a sufficient time and under conditions to enhance cell function in the subject.

11. The method of paragraph 10, wherein the method comprises improving the robustness of the cell under diseased condition.

12. A method of enhancing cell viability in a subject, the method comprising administering to the subject an inhibitor of a gene or corresponding gene product associated with organ regeneration for a sufficient time and under conditions to enhance cell viability in the subject.

13. A method of treating a liver condition or disease in a subject, the method comprising administering to the subject an inhibitor of a gene or corresponding gene product associated with organ regeneration for a sufficient time and under conditions to treat the liver condition or disease in the subject.

14. A method of protecting a subject from liver damage, the method comprising administering to the subject an inhibitor of a gene or corresponding gene product associated with organ regeneration for a sufficient time and under conditions to protect the subject from liver damage.

15. A method of detecting a liver condition or disease in a subject, the method comprising detecting in a sample the level of one or more biomarkers associated with liver regeneration, wherein a change in the level of the one or more biomarkers as compared to a reference indicates that the subject is suffering from a liver condition or disease.

16. An inhibitor of a gene or corresponding gene product associated with organ regeneration for use in preventing or treating a liver condition or disease in the subject.

17. The inhibitor of paragraph 16, wherein the liver condition or disease is selected from the group consisting of acute liver disease, chronic liver disease, metabolic liver disease, steatosis, liver fibrosis, primary sclerosing cholangitis (PSC), cirrhosis, liver fibrosis, non-alcoholic fatty liver disease (NAFLD), non-alcoholic steatohepatitis (NASH), hepatic ischemia reperfusion injury, primary biliary cirrhosis (PBC) hepatitis or liver damage.

18. The inhibitor of paragraph 17, wherein the inhibitor is capable of stimulating or increasing proliferation of hepatocytes in the subject.

19. Use of an inhibitor of a gene or corresponding gene product associated with organ regeneration in the manufacture of a medicament for preventing or treating a liver condition or disease in the subject.

20. The use of paragraph 19, wherein the liver condition or disease is selected from the group consisting of acute liver disease, chronic liver disease, metabolic liver disease, steatosis, liver fibrosis, primary sclerosing cholangitis (PSC), cirrhosis, liver fibrosis, non-alcoholic fatty liver disease (NAFLD), non-alcoholic steatohepatitis (NASH), hepatic ischemia reperfusion injury, primary biliary cirrhosis (PBC) hepatitis or liver damage.

21. The use of paragraph 19, wherein the inhibitor is capable of stimulating or increasing proliferation of hepatocytes in the subject.

22. A nucleic acid inhibitor consisting, comprising or encoding an RNAi agent having at least 70%, 80%, 90% or 95% sequence identity to an RNA sequence listed in any of Tables 1-14 or an RNAi agent that hybridizes to the complement of an RNA sequence listed in any of Tables 1-14 under stringency conditions.

23. A method of screening for an inhibitor of a gene or corresponding gene product associated with organ regeneration by: a) contacting the gene or corresponding gene product with a chemical compound library, and b) identifying a chemical compound within the library that is binds to the gene or corresponding gene product to inhibit the expression or function of the gene or corresponding gene product.

The features disclosed in the foregoing description, or in the following claims, or in the accompanying drawings, expressed in their specific forms or in terms of a means for performing the disclosed function, or a method or process for obtaining the disclosed results, as appropriate, may, separately, or in any combination of such features, be utilised for realising the invention in diverse forms thereof.

Those skilled in the art will appreciate that the invention described herein is susceptible to variations and modifications other than those specifically described. It is to be understood that the invention includes all such variations and modifications which fall within the spirit and scope. The invention also includes all of the steps, features, compositions and compounds referred to or indicated in this specification, individually or collectively, and any and all combinations of any two or more of said steps or features.

For the avoidance of any doubt, any theoretical explanations provided herein are provided for the purposes of improving the understanding of a reader. The inventors do not wish to be bound by any of these theoretical explanations.

Any section headings used herein are for organizational purposes only and are not to be construed as limiting the subject matter described.

As used in this application, the singular form "a," "an," and "the" include plural references unless the context clearly dictates otherwise. For example, the term "an agent" includes a plurality of agents, including mixtures thereof. Ranges may be expressed herein as from "about" one particular value, and/or to "about" another particular value. When such a range is expressed, another embodiment includes from the one particular value and/or to the other particular value. Similarly, when values are expressed as approximations, by the use of the antecedent "about," it will be understood that the particular value forms another embodiment. The term "about" in relation to a numerical value is optional and means for example +/−10%.

Throughout this specification and the claims which follow, unless the context requires otherwise, the word "comprise", and variations such as "comprises" and "comprising", will be understood to imply the inclusion of a stated integer or step or group of integers or steps but not the exclusion of any other integer or step or group of integers or steps.

The reference in this specification to any prior publication (or information derived from it), or to any matter which is known, is not, and should not be taken as an acknowledgment or admission or any form of suggestion that that prior publication (or information derived from it) or known matter forms part of the common general knowledge in the field of endeavor to which this specification relates.

Certain embodiments of the invention will now be described with reference to the following figures and examples which are intended for the purpose of illustration only and are not intended to limit the scope of the generality hereinbefore described. Further aspects and embodiments will be apparent to those skilled in the art. All documents mentioned in this text are incorporated herein by reference.

For standard molecular biology techniques, see Sambrook, J., Russel, D. W. *Molecular Cloning, A Laboratory Manual*. 3 ed. 2001, Cold Spring Harbor, New York: Cold Spring Harbor Laboratory Press, which is hereby incorporated by reference in its entirety.

SUMMARY OF THE FIGURES

Embodiments and experiments illustrating the principles of the invention will now be discussed, by way of non-limiting example only, with reference to the accompanying figures in which:

FIG. 1A, 1B, 1C, 1D. Functional genetic in vivo RNAi screen for modulators of liver regeneration FIG. 1A) Outline of screen. A library of 250 shRNAs targeting 89 genes was delivered to the liver by hydrodynamic-tail vine injection (HDTV) of the transposon based construct (upper panel) in combination with a sleeping beauty 13 (SB13) encoding plasmid (5 independent mice). After stable integration in ~5 to 10% of hepatocytes, thioacetamide (TAA) treatment (3 times per week for 8 weeks) induces chronic liver damage associated with advanced liver fibrosis. Changes in shRNA abundance is detected by deep sequencing. FIG. 1B) Representation of fold change for each shRNA. The majority of shRNAs is depleted but a small number is clearly enriched. FIG. 1C) ROMAampl-library (250shRNAs) distribution. Abundance of potential candidates is shown. Heatmap based representation of enrichment (dark grey) or depletion (light grey) for each animal. Upper panel shows all shRNAs (each raw represents one animal). Lower panel represents a higher magnification for highly significant enriched, depleted and neutral shRNAs (each column represents one animal). FIG. 1D) Functional genetic screen identifies high confidence candidates (zoom in of FIG. 1B) is shown). At least two independent shRNAs were enriched targeting Mfap4, Grhpr, and Itfg1. Furthermore, non-targeting control (shNC) shRNAs (*Renilla*.713 and Luciferase.1309) did not show significant enrichment or depletion and known important liver regeneration genes are depleted, whereas shRNAs targeting the c-Met an essential receptor for liver regeneration are depleted. These results give confidence in the screening approach.

FIG. 2A, 2B, 2C, 2D, 2E, 2F, 2G: In vitro validation of targeting Mfap4 for enhancing regeneration—shRNA mediated knockdown of Mfap4 accelerates proliferation rate in embryonic liver cell line FIG. 2A) Test of knockdown efficiency of top scoring shRNAs targeting Mfap4. Upper panel, retroviral backbone for generating stable cell lines. Lower panel, Western blot showing efficient knockdown of Mfap4 by our shRNAs (control: aTub=α-TUBULIN). FIG. 2B) Schematic outline for stable cell line based assays. FIG. 2C) Wound healing assay in TIB 73 (BNLCL.2) cell line. Stable cell lines were grown to full confluence, then the silicon gasket was removed leaving a defined cell free area. Filling of this "wound" gap was monitored. In the left panels representative images for each group are shown. Three technical replicates were performed. On the right panel the quantification over different time points is shown (Data was analyzed by ImageJ software and 2-way ANOVA test of GraphPad Prism software). Significant difference between shMfap4.1356 (SEQ ID NO: 1), shMfap4.760 (SEQ ID NO: 2) and shNC is shown by '*'). FIG. 2D) EdU incorporation assay. DNA synthesis of TIB 73 cells (BNLCL.2) transfected with shMfap4.1356 (SEQ ID NO: 2) and shNC was assessed by EdU assays. Quantification shows significant difference between experiment and control. Three technical replicates were performed. FIG. 2E) Cell doubling. Doubling time assay results are shown. Cells were seeded at same seeding densities. Doubling time was calculated based on the exponential phase of the growth curve. Three technical replicates were performed. FIG. 2F) Cell cycle analysis by flow cytometry using the Guava Muse Cell Analyzer. Shown is the percentage of cells in the indicated cell cycle phase. Greater amount of cells in G2 phase is indicated in case of experiment (cells with stable Mfap4 knockdown by shMfap4.1356 and shMfap4.760) compared to control NC. FIG. 2G) Wound healing assay using adult liver mouse cell line AML12. Left panel, the same effects were observed as in FIG. 2C). Right panel. quantification of FIG. 2A) shows significantly faster wound closure already at the 14 h timepoint.

FIG. 3B) GFP imager images. GFP imaging of explanted mouse livers shows enhanced clonal expansion (repopulation) of hepatocytes stably expressing shMfap4.1356 (SEQ ID NO: 1) compared to hepatocytes expressing shNC (day 18 after HDTV injection of 25 μg of the indicated plasmid). Representative photographs are shown for each group (n=8 in group with shMfap4.1356, n=6 in group with shMfap4.760, n=6 in group with shNC). Light, white points represent GFP positive macroscopically visible clonal expansions. FIG. 3C) Native GFP on tissue sections. Shown are representative GFP fluorescence photographs of liver sections (200×) of FAH−/− mice 18 days after in vivo delivery of transposon constructs either expressing shMfap4 or a control shRNA corresponding to B). FIG. 3D) Histological analysis (immunostaining against GFP) for GFP-positive cells of mouse livers with stable expression of shMfap4.1356 (SEQ ID NO: 1), shMfap4.760 (SEQ ID NO: 2) and shNC (shown are representative photographs, n=8 in group with shMfap4.1356, n=6 in group with shMfap4.760, n=6 in group with shNC). Day 18 after HDTV injection of 1.25 µg of the indicated plasmid (200× magnification). Increased clonal expansion can be seen for shMfap4. FIG. 3E) Quantification of GFP-positive cells (corresponding to FIG. 3D) shows significant increase in GFP positive hepatocytes in case of Mfap4 knockdown compared to control. Each dot represents one animal. FIG. 3F) Kaplan-Meier survival curve of FAH−/− mice injected with a 1:30 (0.83 µg plasmid and 0.17 mg SB13) dilution of either p/T-FAHIG-shMfap4.1356 (n=5) or p/T-FAHIG-shNC (n=5) and SB13 (p<0.05). NTBC off indicates the time of NTBC drug removal, inducing the selection process (1 day post injection).

FIG. 4A, 4B, 4C, 4D, 4E, 4F, 4G, 4H: "Western Diet" (WD) mouse fatty liver model FIG. 4A) WD+fructose Diet facts. The used diet is rich in fat and carbohydrates. 45% energy comes from fat, predominantly saturated fat, with 0.2% cholesterol. In addition, the animals get 60% fructose/water (wt/vol). FIG. 4B) Pathological evaluation. Histological slides of liver tissue form C56B16 mice exposed for the indicated time to the "Western Diet" or normal chow were evaluated and scored by a certified pathologist. Shown are the scoring results for steatosis and fibrosis. Each point represents an animal. FIG. 4C) Mice on "Western Diet" show a progressive weight gain independent of gender. FIG. 4D) WD model shows progressive fibrosis similar to human patients (see FIG. 4E). FIG. 4E) Progressive increase in fibrosis in human patients based and disease stage, similar to the mouse model (FIGS. 4D & 4B). FIG. 4F). Advanced liver fibrosis can already macroscopically be detected after 24 weeks of WD (representative image). FIG. 4G) After 24 weeks of WD mouse liver show high levels of steatosis (H&E stained liver tissue, representative image). FIG. 4H) Sirius Red staining for collagen fibers indicating advanced fibrosis after 24 weeks of WD exposure.

FIG. 5B) Representative macro-photographs of the livers are shown. Already macroscopically differences between groups were visible. FIG. 5C) Picro Sirius Red staining (staining for fibrotic scar tissue) and Hematoxylin & Eosin staining on sections of indicated repopulated mouse livers (n=5 per experimental group and n=7 per control group; representative sections are shown, 50× magnification). FIG. 5D) The fibrotic score for each animal is shown. The score was given by a certified pathologist, who was blinded regarding the experimental group. Fibrosis score is significantly lower in the experimental group compared to the control group. FIG. 5E) The score of oval cell hyperplasia is shown. The score was given by a certified pathologist, who was blinded regarding the experimental group. The score is significantly lower (=0) in the experimental group compared to the control group. Oval cell hyperplasia is considered a compensatory mechanism, if regeneration through hepatocytes is not sufficient anymore. FIG. 5F) Representative GFP-scanner macro-photographs of the livers are shown. Strong GFP signal on the surface of the livers indicates full repopulation.

FIG. 6B) Representative macro-photographs of the livers are shown. Already macroscopically differences between groups were visible. FIG. 6C) Picro Sirius Red staining (staining for fibrotic scar tissue) and Hematoxylin & Eosin staining on sections of indicated repopulated mouse livers (n=6 per experimental group and n=7 per control group; representative sections are shown, 50× magnification). FIG. 6D) The fibrotic score for each animal is shown. The score was given by a certified pathologist, who was blinded regarding the experimental groups. Fibrosis score is significantly lower in the experimental group compared to the control group.

FIG. 7B) Representative photographs of Ki67 immunofluorescence stained (top row) and DAB Ki67-stained (bottom row) liver sections 48 h post hepatectomy are shown (200× magnification, n=5 per experimental/control group). FIG. 7C) Quantification of Ki67 positive cells of DAB-stained liver sections (corresponding to FIG. 7B)) show increased hepatocyte proliferation after partial hepatectomy in shMfap4-expressing livers compared to shNC livers (individual points represent individual animals, data shows average±SEM, n=5 per group). FIG. 7D) Western blot analyses for cyclin A (nuclear extracts from repopulated mouse livers at the indicated time point) indicate an earlier cell-cycle entry and faster cell-cycle progression of shMfap4-expressing mouse livers (n=2). FIG. 7E) Experimental outline. Immune-competent FAH−/− mice were injected with our constructs, then, mice were kept for full repopulation for 3 months. After that ⅔ of the liver was surgically removed. The remaining regenerating liver was harvested 42 h and 48 h after surgery. FIG. 7F) Representative photographs of DAB Ki67-stained liver sections 42 h (n=5 per experimental group, n=6 per control group) and 48 h (n=5 per experimental group, n=10 per control group) post hepatectomy are shown (200× magnification). FIG. 7G) Quantification of Ki67 positive cells of DAB-stained liver sections (corresponding to FIG. 7B)) show increased hepatocyte proliferation and accelerated liver regeneration after partial hepatectomy in shMfap4-expressing livers compared to shNC livers (individual points represent individual animals, data shows average±SEM). FIG. 7H) Western blot analyses for cyclin E (nuclear extracts from repopulated mouse livers at the indicated time point) indicate an earlier cell-cycle entry and faster cell-cycle progression of shMfap4-expressing mouse livers (n=2). FIG. 7I) GFP-imaging of fully repopulated FAH−/− livers (3 months post-HDTV injections) after ⅔ surgical partial removal of livers corresponding to different time-points of PHx. Strong GFP signal on the surface of the livers indicates full repopulation. FIG. 7J) Representative pictures of DAB GFP staining which show that full repopulation of FAH livers is around 90-95%. Dark brown zones represent repopulated hepatocytes, light brow zones are non-repopulated.

FIG. 8A, 8B, 8C, 8D, 8E, 8F, 8G, 8H, 8I, 8J, 8K: In vivo knockdown of Mfap4 impacts mTOR and p38 signalling FIG. 8A) Schematic outline of experiment. Whole-cell protein extracts from repopulated mouse livers were isolated and analyzed by protein array. FIG. 8B) Heat map shows results for phospho-antibody MAPK pathway protein array. Whole-cell protein extracts from repopulated mouse livers with stable expression of either shMfap4 or shNC were analyzed (shown is the relative spot intensity). FIG. 8C) According to STRING database, all indicated proteins are interacting and are linked to cell growth and proliferation. FIG. 8D) After performing a broad protein array focused Western blot experiments were done. Results of Western blot are shown here. Proteins from fully repopulated livers were isolated. P-P70S6k, β-p38, p-mTOR, p-ERK2 are greater expressed in case of Mfap4 knockdown compare to control and, thus, show stronger activation in case of Mfap4 knockdown compared to control. There are 3 biological replicates in experiment and 3 biological replicates in control. FIG. 8E) Schematic representation for mTOR mediated regulation. The specific mTOR phosphorylation is upstream of p70S6k activation and leads to enforced translation. FIG. 8F) Wound healing under double knockdown conditions. Based on pathway analysis double knockout experiments were commenced. Our stable cell line was expanded, cells were treated with respective siRNAs and the silicon gasket was removed. Wound healing was monitored. Slower growth and migration were observed in case of double-knockdown of Mfap4 and p70S6k and Mfap4 and p38. FIG. 8G) Western blot on proteins from cells in FIG. 8F were isolated. Interestingly p38 knockdown also affects p70S6k. FIG. 8H) Schematic outline of preparation of stable cell line with Mfap4 knockdown for transcriptomic analysis. FIG. 8I) Principal component analysis for AML12-shMfap4.1356, AML12-shMfap4.760, AML12-shNC, (Rb88-RMA050 & Ren_RMA061) and AML12 (AML_RMA052) is shown. We observed cluster separation between experiment and control. FIG. 8J) Heatmap of the following samples is shown. Ptgs2, Areg, Dhrs9, Hmox1, Nqo1 are upregulated in experimental samples compared to control and these genes are known to be involved in liver regeneration according to the literature. FIG. 8K) String Database shows connections between proteins which are upregulated according to FIGS. 8D and 8J.

FIG. 9B) EdU incorporation assay. DNA synthesis of HepG2 cells transfected with hushMfap4 and shNC was assessed by EdU assays. Quantification shows significant difference between experiment and control. FIG. 9C-9E) Transcriptomic analysis of liver samples from ~150 patients shows increased Mfap4 expression in NAFLD patients with cirrhosis and fibrosis 4 score (Table: boxes indicate disease stages with significant change, but less than log 2 2 fold change; grey mark indicates significant upregulation of at least log 2 2 fold; *p<0.05, p<0.01, *p, 0.005). FIG. 9F) Human tissue samples from healthy and cirrhotic liver was stained for Mfap4 protein (Mfap4 specific antibody & DAB staining). On the left side healthy liver tissue was stained without primary antibody as a control. In the middle, the staining of healthy liver indicates hepatocytes are slightly positive for Mfap4. Interestingly we also see some nuclear staining. Right panel shows staining of cirrhotic human liver. Human hepatocytes show strong staining in cytoplasm as well as nuclear staining. On the left side of the cirrhotic liver fibrotic scar tissue can be seen and is highly positive for Mfap4. FIG. 9G) Knockdown test of human MFAP4 siRNA pool. Western blot analysis of protein extracts from immortalized human hepatocytes (Creative Bioarray CSC-19016L) either treated with si huMFAP4 or siNC, α-Tubulin serves as loading control (n=3). FIG. 9H) EdU incorporation assay shows greater number of EdU-positive cells in experiment compared to control. FIG. 9I) EdU incorporation assay (3 technical replicates). Shown is the value of % EdU positive cells±SEM. Immortalized human hepatocytes were either treated with siRNA targeting human MFAP4 or siNC as control (*p<0.05). FIG. 9J) Scheme of retroviral backbone for generating stable cell lines. FIG. 9K) Representative GFP pictures of immortalized Human Hepatocytes (Creative Bioarray CSC-19016L) with stable integration of shRNAs against human Mfap4. FIG. 9L) qPCR analysis showing efficient knockdown of huMfap4 by two shRNAs—hu shMfap4.1812 (SEQ ID NO: 7100) and hu shMfap4.1602 (7097) compared to non-targeting control. FIG. 9M) Western blot showing efficient knockdown of human Mfap4 by two independent shRNAs in immortalized human hepatocytes-SV40. FIG. 9N) Mfap4 knockdown in human immortalized hepatocytes accelerates wound healing. Wound healing assay using immortalized human hepatocytes with stable expression of shhuMFAP4.1602 or shNC respectively. Cells were grown to full confluence, then the silicon gasket was removed leaving a defined cell free area (0 h). Filling of this "wound" gap was monitored (48 h; n=3 for each condition). FIG. 9O) Quantification of L), wound healing area (n=3; *p<0.05, ns=non-significant).

FIG. 10B) Test of knockdown efficiency of top scoring shRNAs targeting Grhpr. Western blot showing efficient knockdown of Grhpr by our shRNAs (Alpha-tubulin, αTub functions as loading control). FIG. 10C) Wound healing assay. Stable cell lines were grown to full confluence, then the silicon gasket was removed leaving a defined cell free area. Filling of this "wound" gap was monitored. Representative images for each group are shown. FIG. 10D) Quantification over different time points of wound healing assay is shown (Data was analyzed by ImageJ software and 2-way ANOVA test of GraphPad Prism software. Significant difference between shGrhpr361 (SEQ ID NO: 3) and shNC is shown by '*').

FIG. 11A, 11B, 11C, 11D, 11E, 11F, 11G: Grhpr knockdown accelerates liver repopulation FIG. 11A) Outline shows the transposon based vector for the expression of the enzyme FAH, the marker GFP and the shRNA of interest. FIG. 11B) FAH knockout mice based liver repopulation assay. Outline shows the rational for the assay. If the knockdown of a certain shRNA is able to enhance regeneration and accelerate hepatocyte proliferation, we should be able to see a faster clonal expansion compared to a control shRNA starting from the stably integrated hepatocytes. FIG. 11C) GFP imager images. GFP imaging of explanted mouse livers shows enhanced clonal expansion (repopulation) of hepatocytes stably expressing shGrhpr.361 (SEQ ID NO: 3) compared to hepatocytes expressing shNC (day 18 after HDTV injection of 25 µg of the indicated plasmid). Representative photographs are shown for each group (n=5). Light, white points represent GFP positive macroscopically visible clonal expansions. FIG. 11D) Native GFP on tissue sections. Shown are representative GFP fluorescence photographs of liver sections (200×) of FAH−/− mice 18 days after in vivo delivery of transposon constructs either expressing shGrhpr or a control shRNA corresponding to C). FIG. 11E) Histological analysis (immunostaining against GFP) for GFP-positive cells of mouse livers with stable expression of shGrhpr.361 (SEQ ID NO: 3) and shNC (shown are representative photographs, n=5 in group with shGrhpr.361, n=5 in group with shNC). Day 18 after HDTV injection of 1.25 µg of the indicated plasmid (200× magnification). Increased clonal expansion can be seen for shMfap4. FIG. 11F) Quantification of GFP-positive cells (corresponding to E)) shows significant increase in GFP positive hepatocytes in case of Mfap4 knockdown compared to control. Each dot represents one animal. FIG. 11G) Survival curve with dilution of constructs (1:30) as 0.83 µg plasmid and 0.17 mg SB13. All experimental mice with shGrhpr constructs (n=5) survived whereas control mice died (n=5).

FIG. 12B) Representative photographs of Ki67 DAB-stained liver sections (200× magnification) at 24 hours' (n=5 per group), 38 hours' (n=6 per group), 48 hours' (n=9 per group) time points after partial hepatectomy. Earlier and increased hepatocyte proliferation after partial hepatectomy in shGrhpr-expressing livers compared to shNC livers can be seen. FIG. 12C) Quantification of Ki67 positive cells of DAB-stained liver sections (corresponding to B)) show earlier and increased hepatocyte proliferation after partial hepatectomy in shGrhpr-expressing livers compared to shNC livers (individual points represent individual animals, data shows average±SEM). FIG. 12D) Schematic representation of peak shifting of mitotic cycle in case of Grhpr knockdown compare to control shNC (corresponding to C)).

FIG. 13B) Representative macro-photographs of the livers are shown. Already macroscopically differences between groups were visible. FIG. 13C) Sirius Red staining (staining for fibrotic scar tissue) and Hematoxylin & Eosin staining on sections of indicated repopulated mouse livers (n=5 per each group, 50× magnification). FIG. 13D) The fibrotic score for each animal is shown. The score was given by a certified pathologist, who was blinded regarding the experimental groups.

FIG. 14B) Representative macro-photographs of the livers are shown. FIG. 14C) Sirius Red staining (staining for fibrotic scar tissue) and Hematoxylin & Eosin staining on sections of indicated repopulated mouse livers (n=6 per experimental group and n=7 per control group; representative sections are shown, 50× magnification). FIG. 14D) The fibrotic score for each animal is shown. The score was given by a certified pathologist, who was blinded regarding the experimental group.

FIG. 16A, 16B, 16C, 16D, 16E, 16F, 16G, 16H: Itfg1 knockdown accelerates wound healing and liver repopulation FIG. 16A) Outline of retroviral backbone for generating stable cell lines. FIG. 16B) Test of knockdown efficiency of top scoring shRNAs targeting Itfg1. qPCR analysis and Western blot analysis show efficient knockdown of Itfg1 by our shRNAs. FIG. 16C) Itfg1 knockdown accelerates wound healing in vitro. Stable cell lines were grown to full confluence, then the silicon gasket was removed leaving a defined cell free area. Filling of this "wound" gap was monitored. Representative images are shown in upper part. Quantification over different time points of wound healing assay is shown (lower part, Data was analyzed by ImageJ software and 2-way ANOVA test of GraphPrizm software. Significant difference between shItfg1.698 (SEQ ID NO: 6), shItfg1.680 (SEQ ID NO: 7) and shNC is shown by '*'). FIG. 16D) Outline shows the transposon-based vector for the expression of the enzyme FAH, the marker GFP and the shRNA of interest (upper panel). Lower panel shows FAH knockout mice based liver repopulation assay. Outline shows the rational for the assay. If the knockdown of a certain shRNA is able to enhance regeneration and accelerate hepatocyte proliferation, we should be able to see a faster clonal expansion compared to a control shRNA starting from the stably integrated hepatocytes. FIG. 16E) GFP imager images. GFP imaging of explanted mouse livers shows enhanced clonal expansion (repopulation) of hepatocytes stably expressing shItfg1 compared to hepatocytes expressing shNC (day 18 after HDTV injection of 1.25 µg of the indicated plasmid; representative photographs are shown; n=8 per experimental group with knockdown by shItfg1.698, n=6 per experimental group with knockdown by shItfg1.680, and n=6 per control group). Light, white points represent GFP positive macroscopically visible clonal expansions. FIG. 16F) Histological analysis (immunostaining against GFP) for GFP-positive cells of mouse livers with stable expression of shItfg1.698, shItfg1.680 and shNC (shown are representative photographs). Day 18 after HDTV injection of 1.25 µg of the indicated plasmid (200× magnification). Increased clonal expansion can be seen for shItfg1. FIG. 16G) Quantification of GFP-positive cells (corresponding to F)) shows significant increase in GFP positive hepatocytes in case of Itfg1 knockdown compared to control. Each dot represents one animal. FIG. 16H) Repopulation survival assay. The right panel shows the outline of the experiments. We further diluted the plasmid amount delivered to the liver. At a certain dilution the amount of hepatocytes with stable integration will be not enough to expand and compensate for the loss of FAH−/− hepatocytes. However, if the knockdown by our candidate accelerates repopulation it might be sufficient to compensate and allow survival. Left panel shows the survival curve after 1:30 dilution. All animals injected with our construct expressing the control shRNA died, whereas all mice injected with our construct expressing shItfg1 survived. There is statistical significance between experiment and control. Statistical significance was calculated using a log rank test (n=5 per group).

FIG. 17B) Representative macrophotographs of the livers are shown. Already macroscopically differences between groups were visible. FIG. 17C) Picro Sirius Red staining (staining for fibrotic scar tissue) and Hematoxylin & Eosin staining on sections of indicated repopulated mouse livers (n=6 for shItfg1.698 and n=7 for control group, 50× magnification). FIG. 17D) The fibrotic score for each animal is shown. The score was given by a certified pathologist, who was blinded regarding the experimental groups. FIG. 17E) Representative macro-photographs of the livers with GFP-imaging system is shown. Livers are all green, hence fully repopulated.

FIG. 18A, 18B, 18C, 18D, 18E, 18F, 18G, 18H, 18I: ITFG1 expression in human liver tissue; knockdown protects against NASH related fibrosis (see also FIG. 35A-35F). FIG. 18A) Macroscopic pictures of mice with repopulated liver exposed to Western Diet. shItfg1 indicates liver was repopulated so that every hepatocyte expresses the shRNA targeting Itfg1, whereas shNC indicates repopulation so that every hepatocyte expresses a non-targeting control shRNA. Already macroscopically, livers with Itfg1 knockdown show reduced fibrosis. FIG. 18B-18D) Transcriptomic analysis of liver samples from ~150 patients show no significant expression change for Itfg1. FIG. 18E) ITFG1 is expressed in healthy liver tissue and in NASH Cirrhosis. FIG. 18F) Expression of ITFG1 in human tissues is shown. Data is taken from The Human Protein Atlas. FIG. 18G) Low expression of ITFG1 is associated with longer survival in case of liver cancer. Data is taken from The Human Protein Atlas. FIG. 18H) Scheme of retroviral backbone for generating stable cell lines. FIG. 18I) shRNAs efficiently targeting human ITFG1 were identified. Knockdown test by Western blot analysis using whole-cell lysates. HepG2 cells stably expressing the shRNA of interest were generate by retroviral infection and selection. GAPDH serves as a loading control.

FIG. 19B) Representation of fold change for each shRNA passing a β-value of 0.1 from male mice exposed to choline-deficient L-amino acid defined high fat diet for 8 weeks. The majority of shRNAs is deplete but a small number is clearly enriched. FIG. 19C) Principal component analysis based on normalized shRNA abundance level. We can see a clear separation based on diet exposure. FIG. 19D) Heatmap based enrichment/depletion for each animal for top-enriched and depleted shRNAs. Based on our analysis we identified 6 high confidence targets.

FIG. 20A, 20B: CDHFD mouse fatty liver model FIG. 20A) Choline deficient L-amino acid defined high fat diet (CDHFD) leads to fast and progressive fatty liver disease in mice. Already after 8 weeks of diet exposure mice show NASH with advanced fibrosis. FIG. 20B) Pathological evaluation. Histological slides of liver tissue form C56B16 mice exposed to the indicated time to the CDHFD or normal chow were evaluated and scored by a certified pathologist. Shown are the scoring results for steatosis and fibrosis. Each point represents an animal.

FIG. 21B) Summary of screening result for the shRNA expression cassette targeting Abcc4. Shown are the average relative reads for each group, the fold change and the log 2 fold change comparing CDHFD mice to NC mice. FIG. 21C-21E) Transcriptomic analysis of liver samples from ~150 patients show significant increase in Abcc4 gene expression at NASH late fibrosis and cirrhosis stage. Furthermore, an increase expression can be detected based on ballooning and fibrosis stage (Table: grey mark indicates significant upregulation of at least log 2 2 fold; *p<0.05, p<0.01, *p,0.005).

FIG. 22A, 22B, 22C, 22D, 22E: Pak3 is a potential therapeutic target for NAFLD FIG. 22A) Shown is the relative read numbers for the shRNA expression cassette targeting Pak3 for each animal (NC=normal chow, CD=CDHFD). FIG. 22B) Summary of screening result for the shRNA expression cassette targeting Pak3. Shown are the average relative reads for each group, the fold change and the log 2 fold change comparing CDHFD mice to NC mice. FIG. 22C-22E) Transcriptomic analysis of liver samples from ~150 patients show significant increase in Pak3 gene expression at NASH cirrhosis stage. Furthermore, an increase expression can be detected based on fibrosis stage (Table: grey mark indicates significant upregulation of at least log 2 2 fold; *p<0.05, p<0.01, *p,0.005).

FIG. 23A, 23B, 23C, 23D, 23E: Trnp1 is a potential therapeutic target for NAFLD FIG. 23A) Shown is the relative read numbers for the shRNA expression cassette targeting Trnp1 for each animal (NC=normal chow, CD=CDHFD). FIG. 23B) Summary of screening result for the shRNA expression cassette targeting Trnp1. Shown are the average relative reads for each group, the fold change and the log 2 fold change comparing CDHFD mice to NC mice. FIG. 23C-23E) Transcriptomic analysis of liver samples from ~150 patients show significant increase in Trnp1 gene expression at NASH cirrhosis stage. Interestingly, with increased steatosis and inflammation expression seems to be downregulated (Table: grey mark indicates significant upregulation of at least log 2 2 fold; boxed grey mark indicates significant downregulation of at least log 2 2 fold; *p<0.05, p<0.01, *p,0.005).

FIG. 24A, 24B, 24C, 24D, 24E: Apln is a potential therapeutic target for NAFLD FIG. 24A) Shown is the relative read numbers for the shRNA expression cassette targeting Apln for each animal (NC=normal chow, CD=CDHFD). FIG. 24B) Summary of screening result for the shRNA expression cassette targeting Apln. Shown are the average relative reads for each group, the fold change and the log 2 fold change comparing CDHFD mice to NC mice. FIG. 24C-24E) Transcriptomic analysis of liver samples from ~150 patients show significant increase in Apln gene expression at NASH cirrhosis stage. Interestingly, with increased inflammation expression seems to be downregulated (Table: grey mark indicates significant upregulation of at least log 2 2 fold; boxed grey mark indicates significant downregulation of at least log 2 2 fold; *p<0.05, p<0.01, *p,0.005).

FIG. 25B) Summary of screening result for the shRNA expression cassette targeting Kif20a. Shown are the average relative reads for each group, the fold change and the log 2 fold change comparing CDHFD mice to NC mice. FIG. 25C-25E) Transcriptomic analysis of liver samples from ~150 patients show a progressive increase in Kif20a gene expression till the NASH advanced fibrosis stage (Table: grey mark indicates significant upregulation of at least log 2 2 fold; *p<0.05, p<0.01, *p,0.005)

FIG. 26A, 26B, 26C, 26D, 26E: Ltb is a potential therapeutic target for NAFLD FIG. 26A) Shown is the relative read numbers for the shRNA expression cassette targeting Ltb for each animal (NC=normal chow, CD=CDHFD). FIG. 26B) Summary of screening result for the shRNA expression cassette targeting Ltb. Shown are the average relative reads for each group, the fold change and the log 2 fold change comparing CDHFD mice to NC mice. FIG. 26C-26E) Transcriptomic analysis of liver samples from ~150 patients show a progressive increase in Ltb gene expression till the NASH advanced fibrosis stage (Table: grey mark indicates significant upregulation of at least log 2 2 fold; *p<0.05, p<0.01, *p,0.005).

FIG. 28B) Bright field. Representative pictures are shown (both surfaces of the liver) (n=5 mice per experimental group, n=5 mice per control group). FIG. 28C) GFP-imaging. Representative pictures are shown (both surfaces of the liver). No GFP-positive tumor is observed. Livers are fully repopulated (strong GFP-positive signal). FIG. 28D) Hematoxylin & Eosin staining. Representative pictures are shown. No malignant disease is observed in both: experimental group and control group. Pathology evaluation is conducted by certified pathologist. The pathologist did not find malignant lesions in the liver. FIG. 28E) GFP (DAB) staining. Representative pictures are shown. Around 95% of hepatocytes are GFP-positive which means livers were fully repopulated.

FIG. 29B) Western blot analysis with concentration 6 µM shows efficient knockdown of Mfap4 by two different conjugates GalNAC-si Mfap4.1356 (SEQ ID NOs: 7092) and GalNAC-si Mfap4. 760 (SEQ ID NOs: 7093) compared to control. FIG. 29C) Western blot analysis with concentration 11 µM shows efficient knockdown of Mfap4 by two different conjugates GalNAC-si Mfap4.1356 and GalNAC-si Mfap4. 760 compared to control.

FIG. 30A, 30B, 30C: Grhpr knockdown for 1 year does not lead to liver cancer FIG. 30A) Schematic representation of the experiment. FAH−/− mice were injected with p/T-FAHIG-shRNA & SB13 expressing constructs via HDTV; then, mice were kept for 1 year to observe any tumor formation or abnormal liver histology. Livers were harvested at 1 year after injections. FIG. 30B) Bright field. Representative pictures are shown (both surfaces of the liver) (n=3 mice per experimental group, n=5 mice per control group). FIG. 30C) GFP-imaging. Representative pictures are shown (both surfaces of the liver). No GFP-positive tumor is observed. Livers are fully repopulated (strong GFP-positive signal).

FIG. 31B) shRNAs efficiently targeting human Grhpr were identified. Knockdown test by qPCR using whole-cell lysates. HepG2 cells were cotransfected with pMSCV vector. FIG. 31C) Knockdown test by Western blot using whole-cell lysates. HepG2 cells with stable expression of indicated shRNAs were generated by retroviral infection and selection. Tubulin serves as a loading control.

FIG. 32B) Western blot analysis with concentration 6 µM shows efficient knockdown of Grhpr by conjugate GalNAC-si Grhpr.361 (SEQ ID NO: 7094) compared to scrambled control. Western blot analysis with concentration 11 µM shows efficient knockdown of Grhpr by conjugate GalNAC-si Grhpr.361 compared to scrambled control.

FIG. 33B) Representative photographs of DAB Ki67-stained liver sections 42 h (n=4 per experimental group, n=6 per control group) and 48 h (n=5 per experimental group, n=10 per control group) post hepatectomy are shown (200× magnification). FIG. 33C) Quantification of Ki67 positive cells of DAB-stained liver sections (corresponding to B) show increased hepatocyte proliferation after partial hepatectomy in shItfg1-expressing livers compared to shNC livers (individual points represent individual animals, data shows average±SEM).

FIG. 34A, 34B, 34C, 34D, 34E, 34F, 34G: Itfg1 knockdown for 1 year does not lead to liver cancer FIG. 34A) Schematic representation of the experiment. FAH−/− mice were injected with p/T-FAHIG-shRNA & SB13 expressing constructs via HDTV; then, mice were kept for 1 year to observe any tumor formation or abnormal liver histology. Livers were harvested at 1 year after injections. FIG. 34B) Bright field. Representative pictures are shown (both surfaces of the liver). No tumor is observed (n=5 mice per experimental group, n=5 mice per control group). FIG. 34C) GFP-imaging. Representative pictures are shown (both surfaces of the liver). No GFP-positive tumor is observed. Livers are fully repopulated (GFP-positive). FIGS. 34D and 34F) Hematoxylin & Eosin staining. Representative pictures are shown. No malignant disease is observed in both: experimental group and control group. Pathology evaluation is conducted by certified pathologist. FIGS. 34E and 34G) GFP (DAB) staining. Representative pictures are shown. Around 95% of hepatocytes are GFP-positive which means livers were fully repopulated.

FIG. 35B) Representative macro-photographs of the livers are shown. Already macroscopically differences between groups were visible. FIG. 35C) Picro Sirius Red staining (staining for fibrotic scar tissue) and Hematoxylin & Eosin staining on sections of indicated repopulated mouse livers (representative images are shown; n=6 for shItfg1.698 and n=7 for control group, 50× magnification). FIG. 35D) The fibrotic score for each animal is shown. The score was given by a certified pathologist, who was blinded regarding the experimental groups. FIG. 35E) Objective, AI-based analysis of steatosis done by HistoIndex. Representative pictures are shown. FIG. 35F) Quantification analysis shows significantly lower steatosis score in experimental group (n=7 mice per group) compared to control group (n=7 mice per group).

FIG. 36B) After performing a broad protein array focused Western blot experiments were done. Results of Western blot are shown here. Proteins from fully repopulated livers were isolated. Especially P-MKK6/P-MKK3 are greater activated in case of Itfg1 knockdown compared to control. There are 3 biological replicates in experiment and 3 biological replicates in control. FIG. 36C) According to STRING database, all indicated proteins are interacting and are linked to cell growth and proliferation.

FIG. 37B) Western blot analysis with concentration 6 μM shows efficient knockdown of Itfg1 by two different conjugates GalNAC-si Itfg1.698 (SEQ ID NO: 7095) and GalNAC-si Itfg1.680 (SEQ ID NO: 7096) compared to control. Western blot analysis with concentration 11 μM shows efficient knockdown of Itfg1 by two different conjugates GalNAC-si Itfg1.698 and GalNAC-si Itfg1.680 compared to control.

FIG. 38B) Knockdown of Mfap4 as well as the knockdown of Itfg1 accelerates wound healing of mouse lung cells (cell line CCL206). FIG. 38C) Knockdown of Mfap4 as well as the knockdown of Itfg1 accelerates wound healing of mouse myoblast cells (Myoblast cell line CRL1772).

EXAMPLES

Example 1 Functional Genetic In Vivo RNAi Screen

An in vivo functional genetic screen was conducted to identify new modulators of liver regeneration as therapeutic targets to increase endogenous regeneration and counteract liver disease. This approach was originally pioneered by taking advantage of FAH−/− mice. From there the screening set up was further modified and improved, so it can be applied to any mouse independent of genetic background and modification (FIG. 1A). A focused shRNA library was delivered, comprising of 250 shRNAs targeting 89 genes, by hydrodynamic tail vine injection to the liver. Through the combination with a plasmid encoding for the sleeping beauty 13 transposase, stable integration was obtained in around 5 to 10% of hepatocytes. Therefore, a chimeric mouse liver in which the shRNA expressing hepatocytes are surrounded by "wt" hepatocytes is generated. To simulate chronic liver damage the inventors treated 3 times per week for 8 weeks mice with thioacetamid (TAA), a chemical inducing liver damage (FIG. 1A). Cycles of liver damage and compensatory regeneration induce a competitive environment. If the knockdown by a certain shRNA gives an advantage to hepatocytes, the cells will expand and an enrichment for the shRNA can be detected. In contrast, if the expression of a shRNA is detrimental, this shRNA should deplete. No change compared to the starting pool indicates no effect in this environment. The abundance of the shRNAs can be determined by Illumina based deep sequencing. For sequencing, the genomic DNA was isolated from the liver, the shRNA expressing cassette was amplified with primers including Illumina adapter sequences and the product was directly sequenced.

Figure 1D:
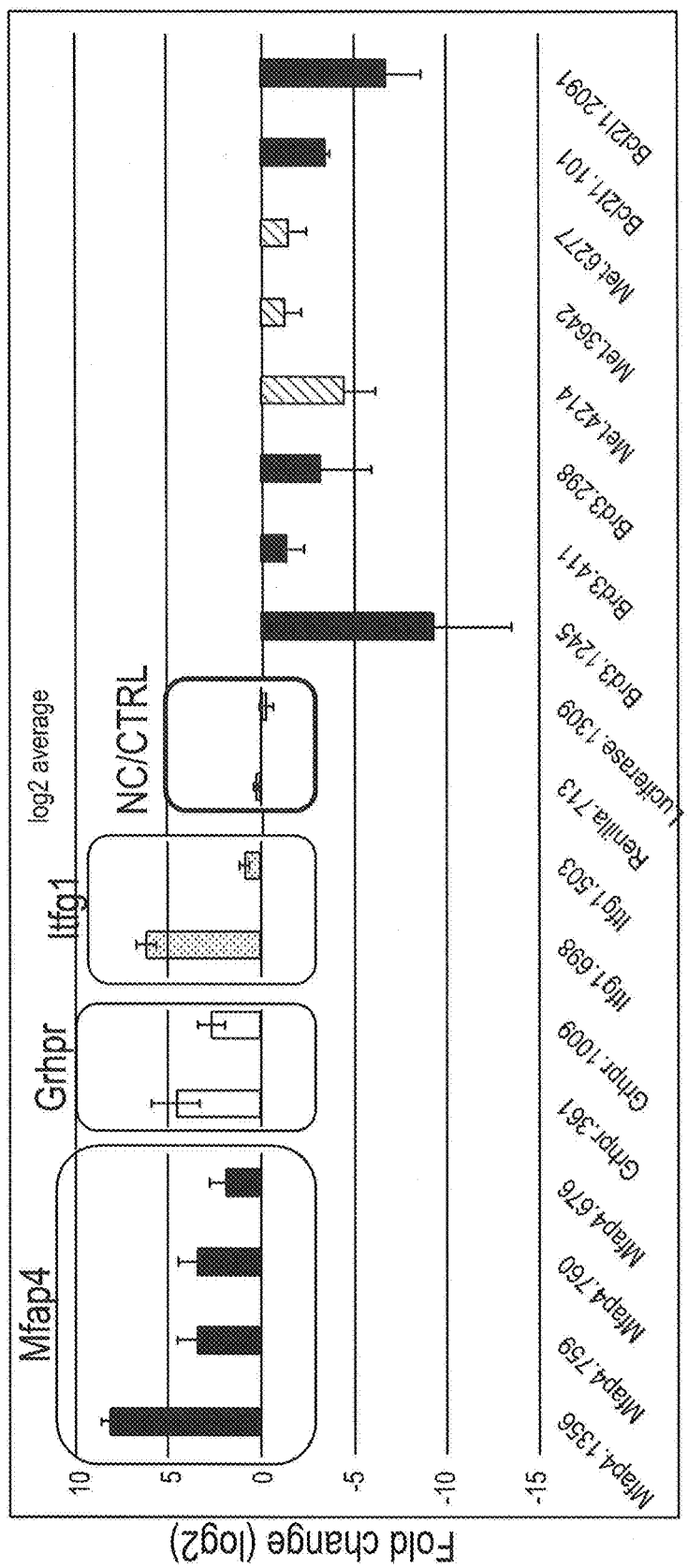

Also, the majority of the shRNAs were depleted in this screen, a subset was consistently enriched in all biological replicates (5 independent mice) (FIG. 1B-1C). Importantly and giving confidence in the screen, two independent non-targeting control shRNAs (also named shNC or shCTRL; one targeting Renilla and one targeting luciferase, both are not expressed in mice) were not enriched or depleted. Furthermore, three independent shRNAs targeting c-Met the receptor for hepatocyte growth factor and essential for liver regeneration were depleted (FIG. 1D). To avoid off-target effects of the shRNAs the inventors focused on targets against which at least two independent shRNAs were enriched (FIG. 1D). Four independent shRNAs were found enriched targeting Mfap4, two independent shRNAs for each targeting Grhpr and Itfg1.

Example 2 Validation of Identified Therapeutic Targets

Mfap4—Microfibril Associated Protein 4

Figure 2A:
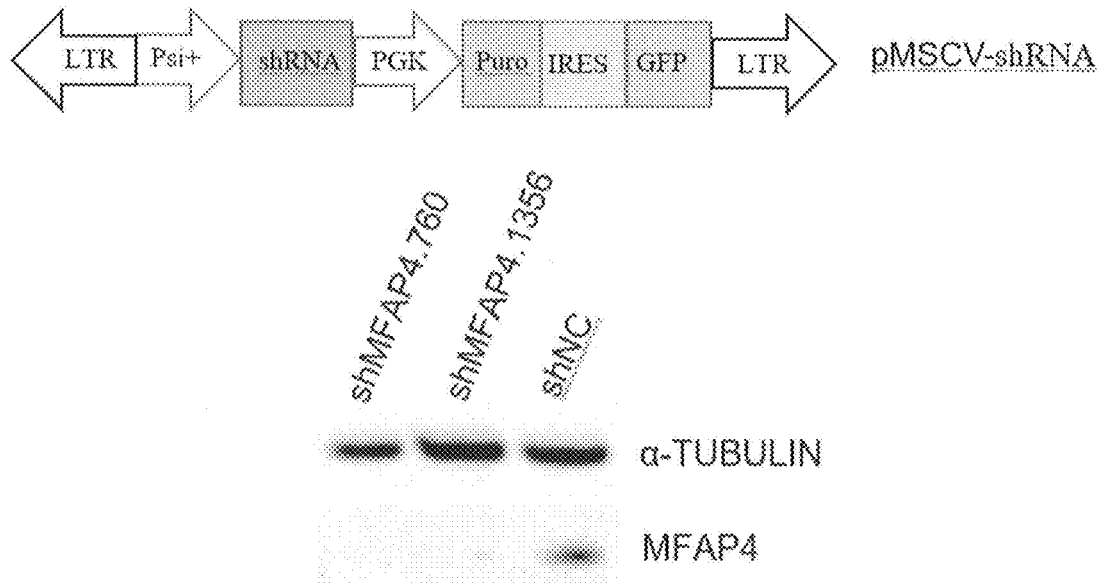
Figure 2B:
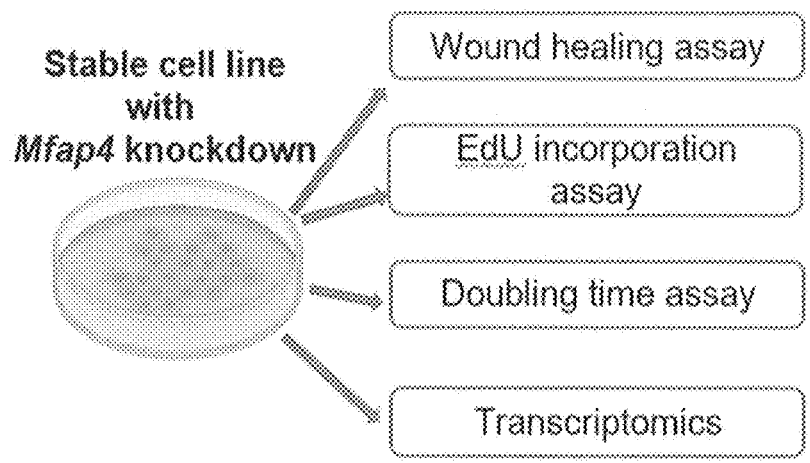
Figure 2D:
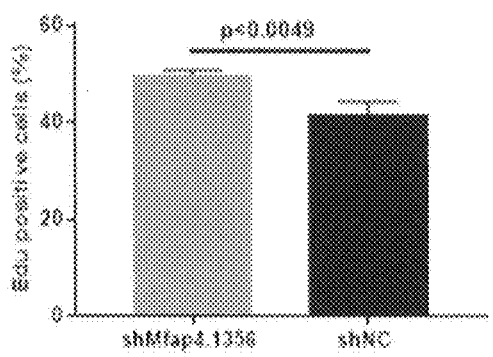

For validation, the knockdown efficiency of the two top-enriched shRNAs targeting Mfap4 in vitro were first tested (FIG. 2A). Both shRNAs show efficient knockdown. For each shRNA stable expressing cell lines (FIG. 2B) were generated as well as for a non-targeting control shRNA and the effect of the shRNAs in a wound healing assay was tested. The knockdown of Mfap4 (two independent shRNAs tested) increased wound closure in TIB 73 (BNLCL.2) cells and AML 12 cells, indicating increased proliferation (FIGS. 2C and 2G). Furthermore, using the stable cell lines the inventors checked for enhanced cell replication by EdU incorporation and determining the cell doubling time (FIG. 2D-2E). Accelerated proliferation was clearly detected. Cell cycle analysis by flow cytometry using the Guava Muse Cell Analyzer showed greater cell amounts (shown is amount of cell in %) in the G2 phase of cell cycle for cells with stable Mfap4 knockdown by shMfap4.1356 (SEQ ID NO: 1) and shMfap4.760 (SEQ ID NO: 2) compared to the non-targeting control (shNC), likewise indicating increased proliferation (FIG. 2F).

Figure 3A:
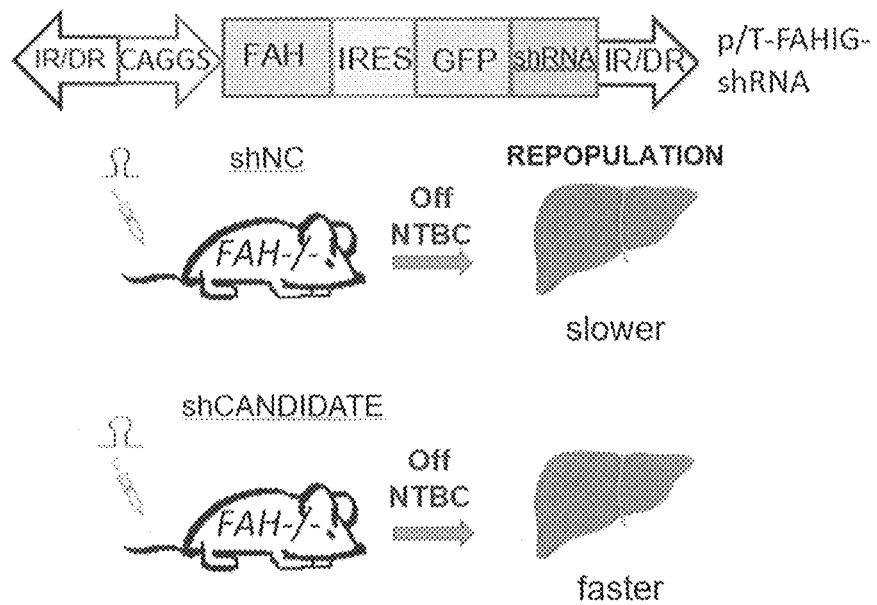
FIG. 3A, 3B, 3C, 3D, 3E, 3F: Mfap4 knockdown accelerates liver repopulation FIG. 3A) FAH knockout mice based liver repopulation assay. Upper panel shows the outline of the transposon based vector for the expression of the enzyme FAH, the marker GFP and the shRNA of interest. Lower panel shows the outline and rational for the assay. If the knockdown of a certain shRNA is able to enhance regeneration and accelerate hepatocyte proliferation, we should be able to see a faster clonal expansion compared to a control shRNA starting from the stably integrated hepatocytes.
Figure 3B:
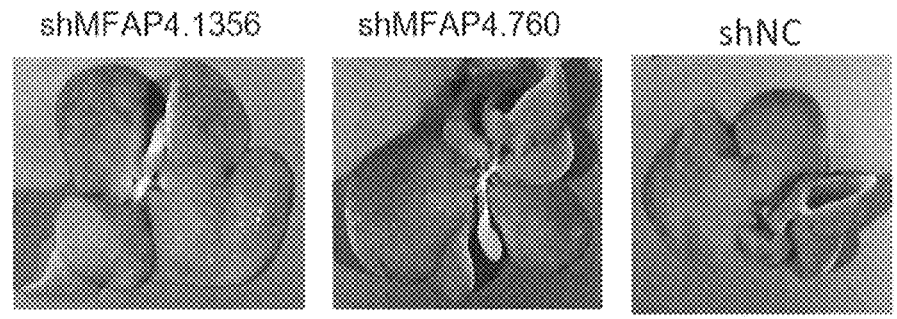
Figure 3C:
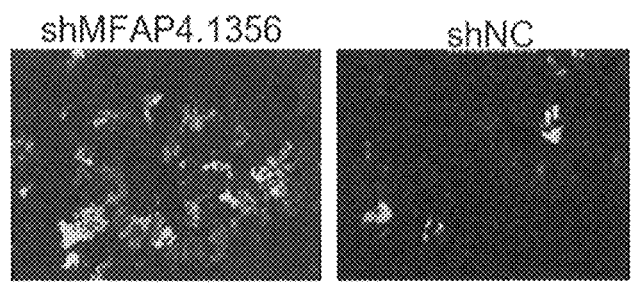
Figure 3D:
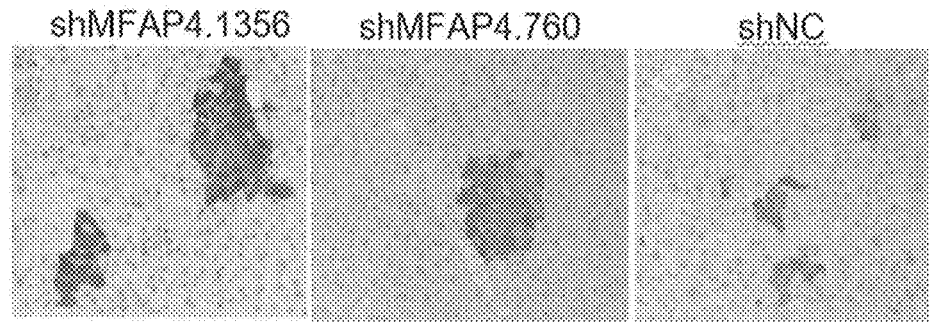
Figure 3E:
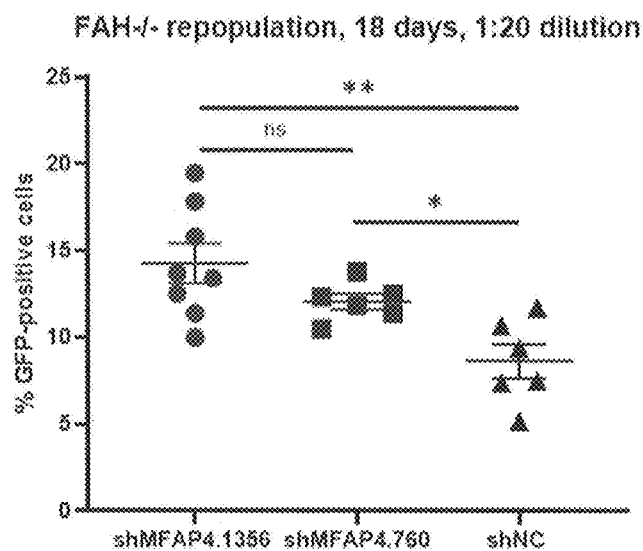
Figure 3F:
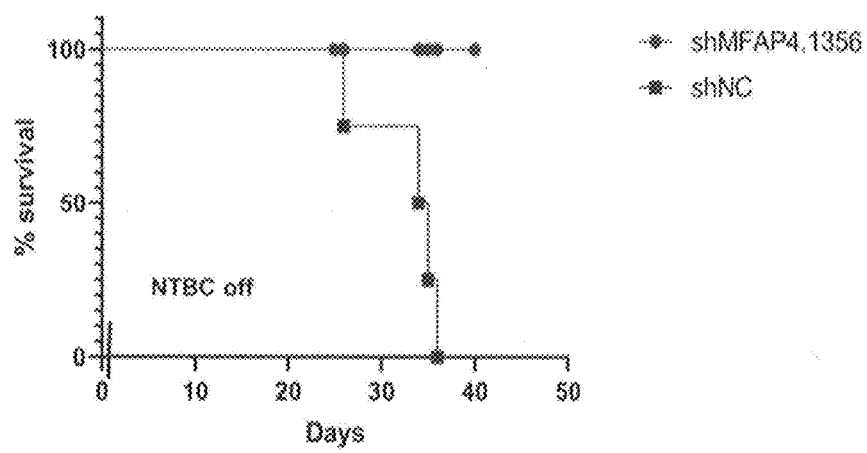

The inventors then took advantage of the FAH (fumarylacetoacetate) knock out mouse. The defect in the tyrosine metabolism leads to the accumulation of toxic side products in hepatocytes resulting in liver failure. Delivering a construct to around 5-10% of hepatocytes for the expression of the missing enzyme FAH and the shRNAs by hydrodynamic tail vine injection, the repopulation efficiency could be tested. If the knockdown by the shRNA targeting Mfap4 enhances regeneration and proliferation, a faster clonal expansion should be seen (FIG. 3A). As expected, knockdown of Mfap4 enhances repopulation detected by GFP-imaging of the whole liver (FIG. 3B), native-GFP fluorescence of cryosections (FIG. 3C) of the liver and antibody based staining for GFP in paraffin sections (FIG. 3D-3E). A further dilution of the amount of injected plasmids could reduce the amount of hepatocytes with stable expression of FAH, GFP and the shRNA of interest, so that the FAH expressing hepatocytes cannot fast enough expand and compensate for FAH−/− hepatocyte loss. However a shRNA dependent acceleration of regeneration might be able to allow survival. At a 1:30 dilution still all shMfap4.1356 (SEQ ID NO: 1) injected mice survive whereas all control shNC injected mice die (FIG. 3F). This further supports the Mfap4 knockdown mediated acceleration, as only in case of Mfap4 the hepatocytes expand fast enough to compensate for hepatocyte loss.

Figure 5A:
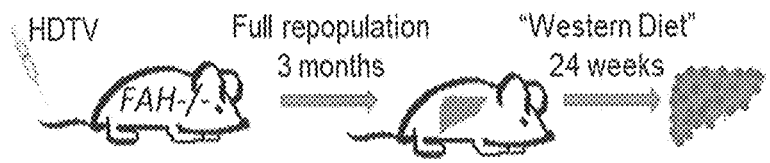
FIG. 5A, 5B, 5C, 5D, 5E, 5F: Mfap4 knockdown attenuates NASH related liver fibrosis FIG. 5A) Experimental outline. FAH−/− mice were injected with our constructs, then, mice were kept for full repopulation for 3 months, so that every hepatocyte in the liver expresses the shRNA construct of interest. After full repopulation was reached mice were exposed to the "Western Diet" (high fat diet and 60% fructose) for 24 weeks. Livers were harvested, processed and analyzed.
Figure 5B:
Figure 5C:
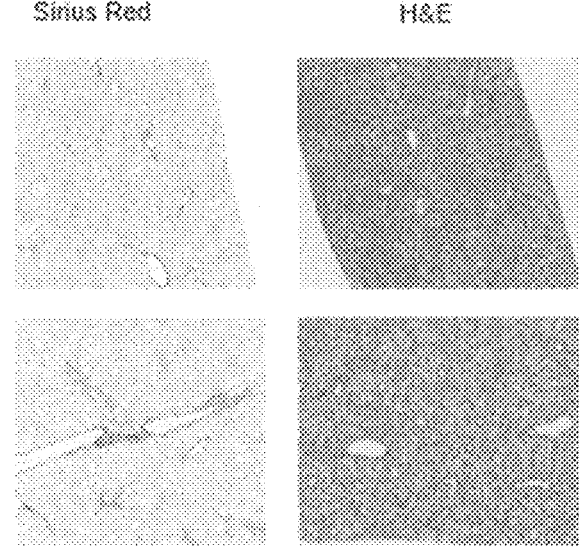
Figure 5D:
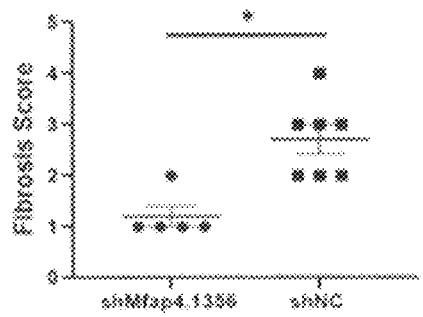
Figure 5E:
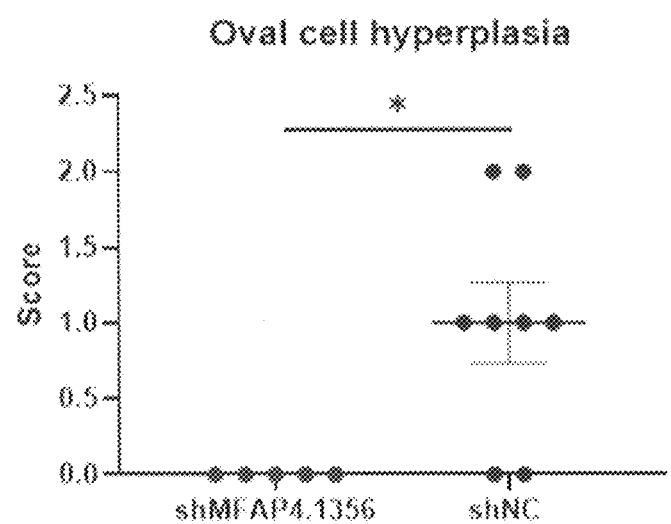
Figure 5F:
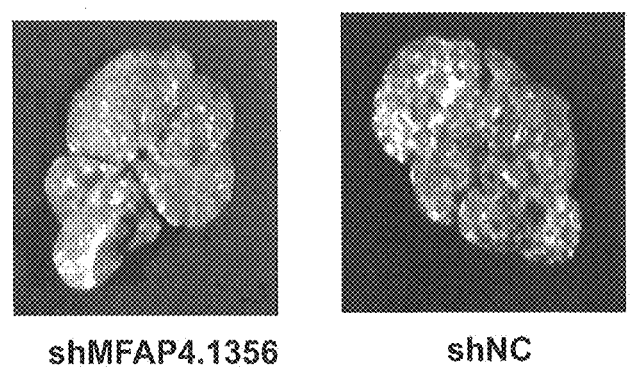
Figure 6A:
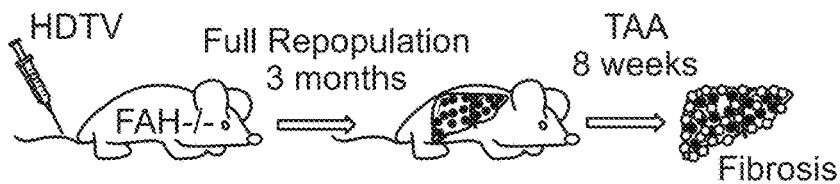
FIG. 6A, 6B, 6C, 6D: Mfap4 knockdown attenuates chronic liver damage related liver fibrosis FIG. 6A) Experimental outline. FAH−/− mice were injected with our constructs, then, mice were kept for full repopulation for 3 months. After that chronic liver damage was induced by repetitive doses of thioacetamide administered intraperitoneal 3 times per week for 8 weeks. Livers were harvested, processed and analyzed.
Figure 6B:
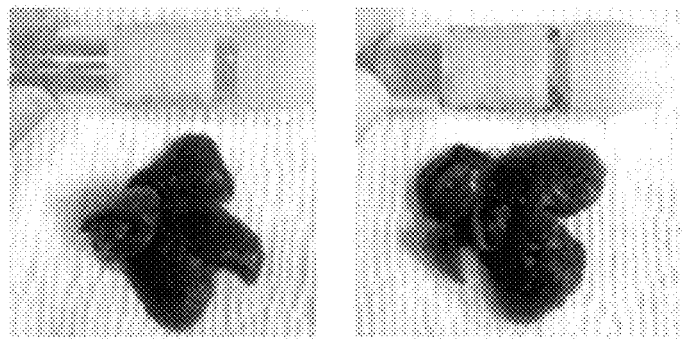
Figure 6C:
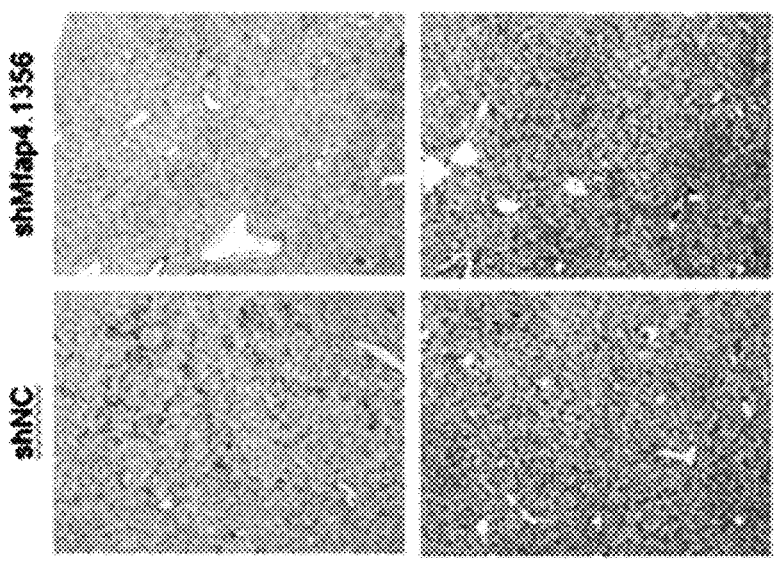
Figure 6D:
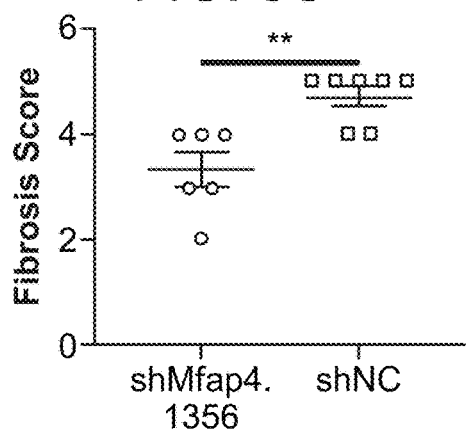
Figure 7A:
FIG. 7A, 7B, 7C, 7D, 7E, 7F, 7G, 7H, 7I, 7J: Mfap4 knockdown accelerates liver regeneration after partial hepatectomy (PH) FIG. 7A) Experimental outline. FRGN were injected with our constructs, then, mice were kept for full repopulation for 3 months. FRGN mice are FAH−/−, Rag2−/−, Il2rg−/− on a NOD background and are immune compromised. After full repopulation of mouse liver, ⅔ of the liver was surgically removed. The remaining regenerating liver was harvested 48 h after surgery.
Figure 7B:
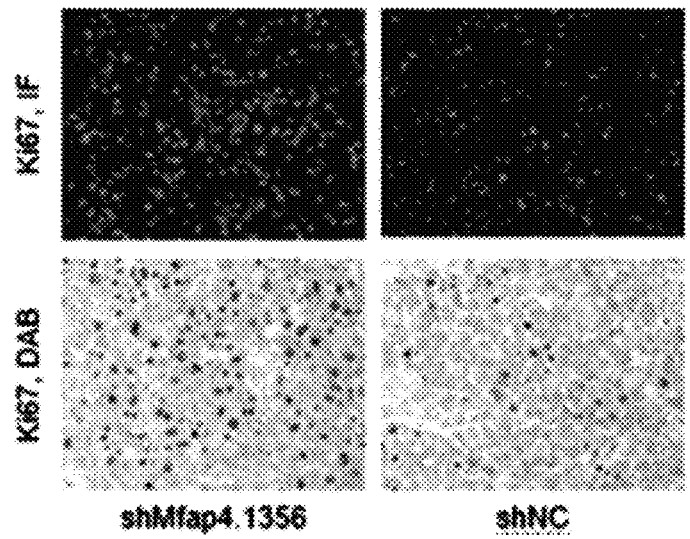
Figure 7C:
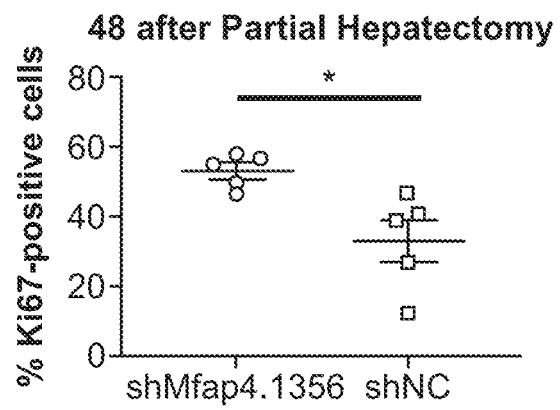
Figure 7D:
Figure 7E:
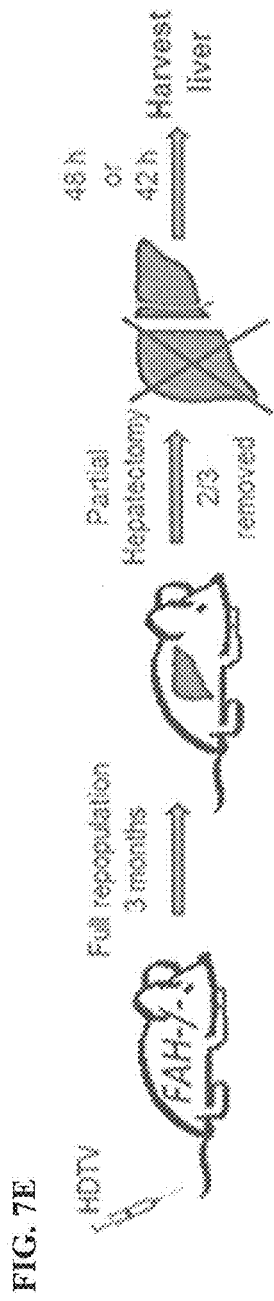
Figure 7F:
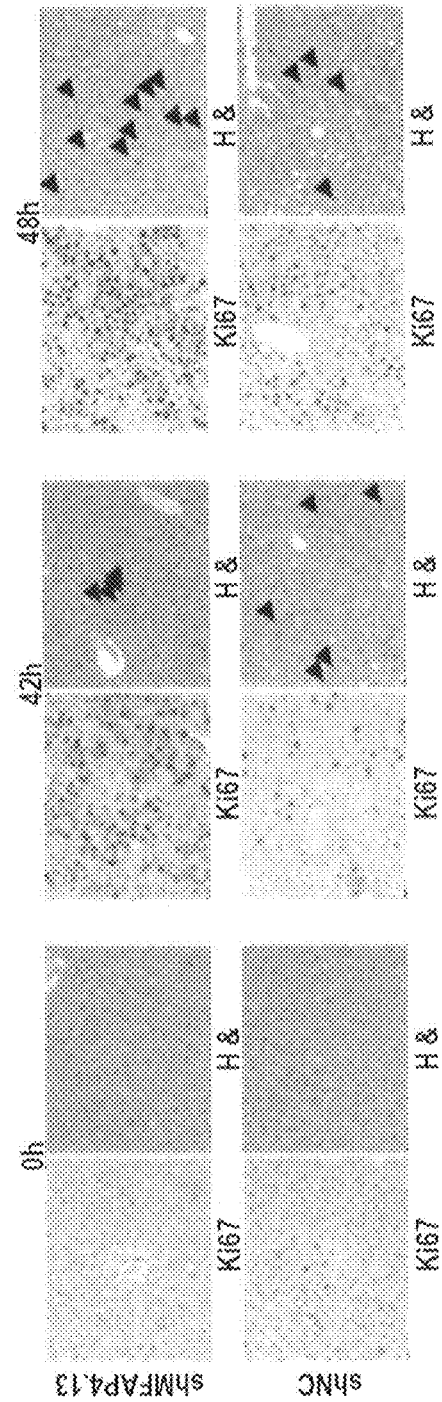
Figure 7G:
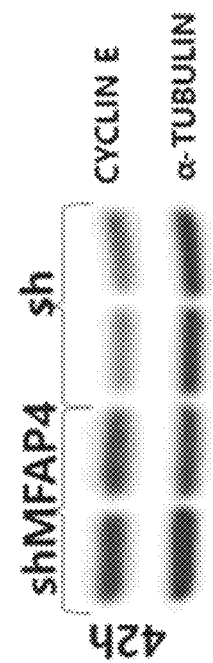
Figure 7H:
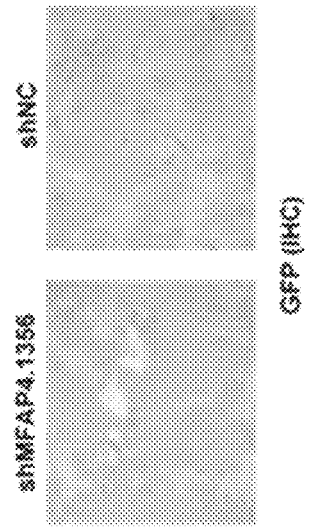
Figure 7I:
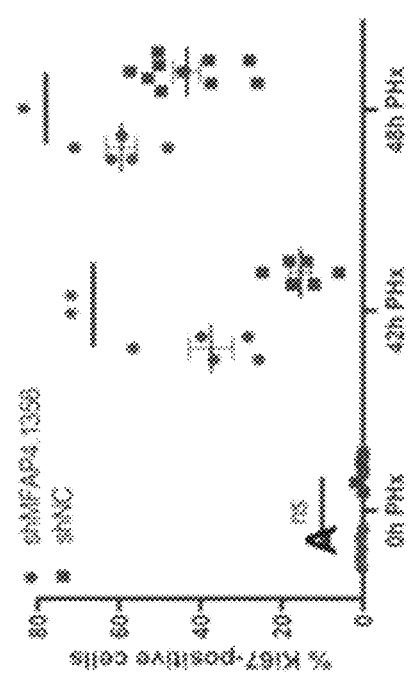
Figure 7J:
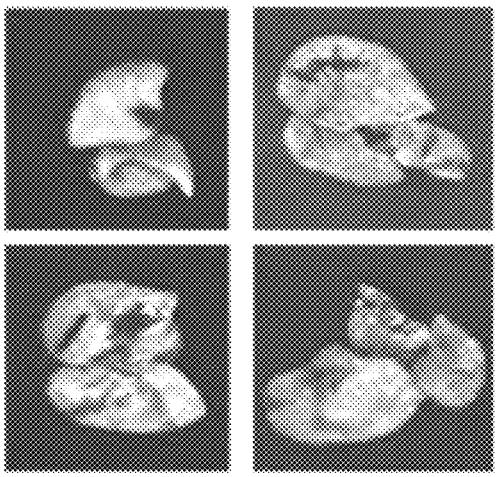

The "Western Diet" induces progressive NAFLD, leading to NASH and fibrosis (FIG. 4). The inventors repopulated FAH−/− mouse liver so that all hepatocytes express either a shRNA targeting Mfap4 or a non-targeting control shRNA. After full repopulation, the mice were exposed to the "Western Diet" (FIG. 5A). Knockdown of Mfap4 clearly attenuates disease progression, reflected in reduced fibrosis (FIG. 5B-5F). Chronic TAA exposure to shMfapp4 and shCTRL repopulated FAH mice (FIG. 6A) was also applied. Consistent with the screening results Mfap4 knockdown protects against TAA induced liver damage and fibrosis (FIG. 6B-6D). As an acute damage model, a ⅔ partial hepatectomy (PH) on repopulated mice (FIGS. 7A and 7E) was performed. Enhanced Ki67 staining (FIGS. 7B-7C and 7F-7G) as well as earlier activation of cyclin A (FIG. 7D) and cyclin E (FIG. 7H), respectively, after PH indicate faster regeneration. GFP-imaging (FIG. 7I) and DAB GFP staining (FIG. 7J) of FAH−/− livers after ⅔ surgical partial removal of livers indicated that mice were fully repopulated.

Figure 8E:
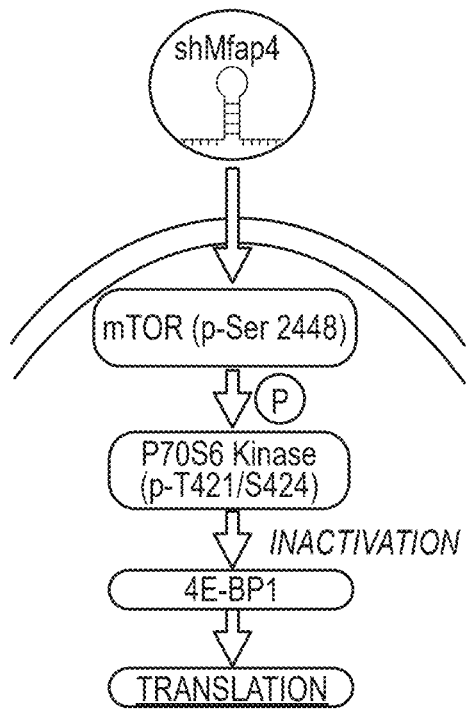
Figure 8F:
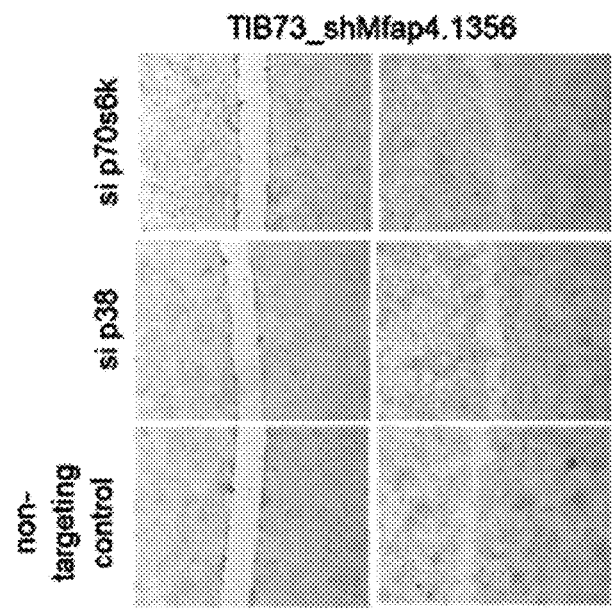
Figure 8G:
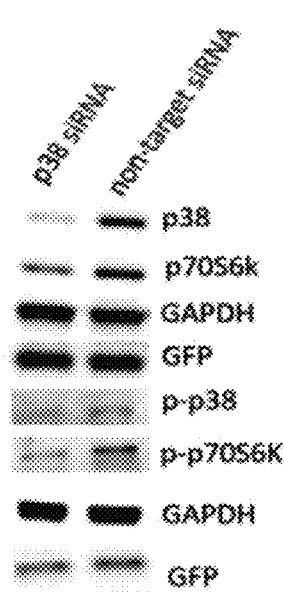
Figure 8H:
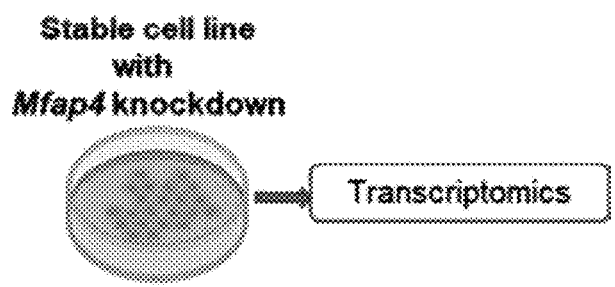
Figure 8I:
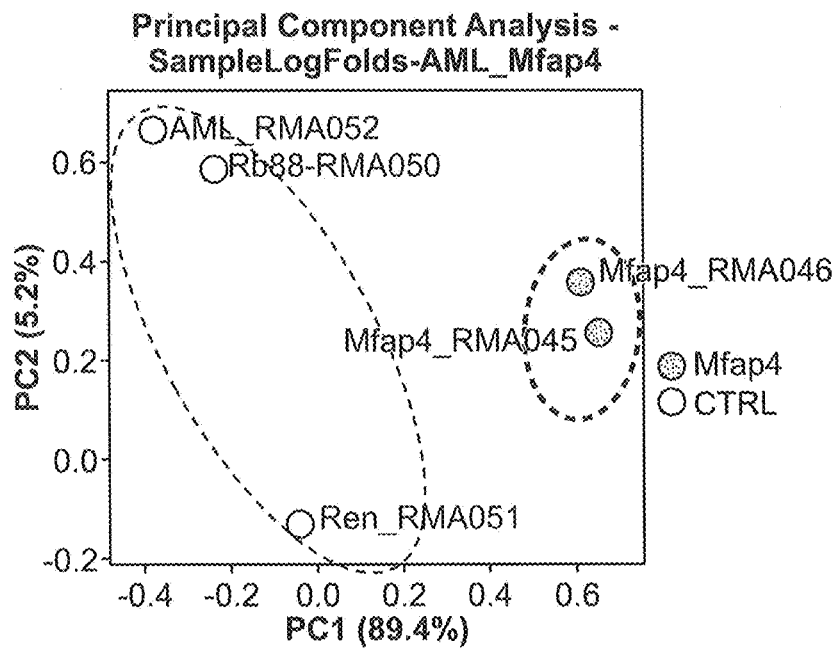
Figure 8J:
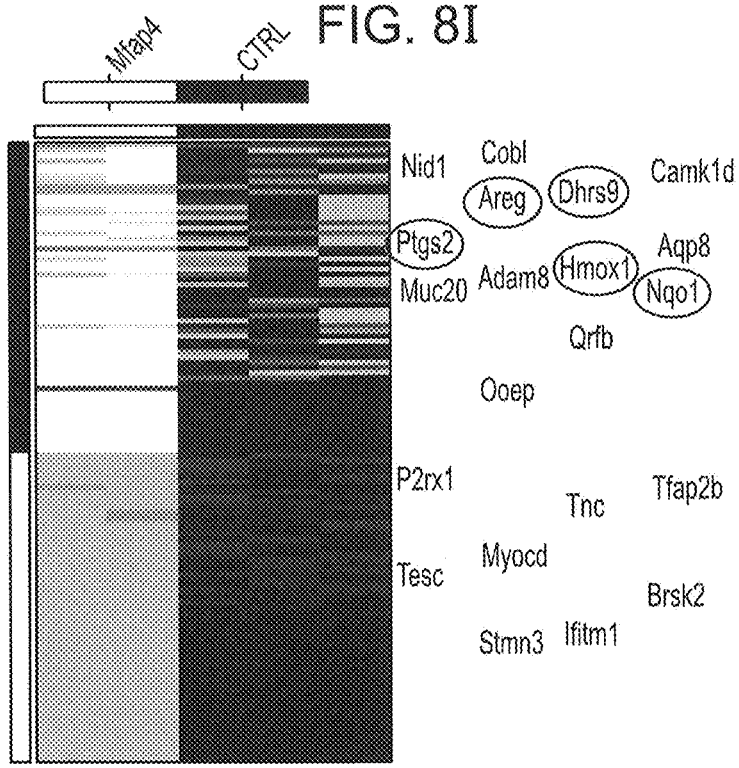
Figure 8K:
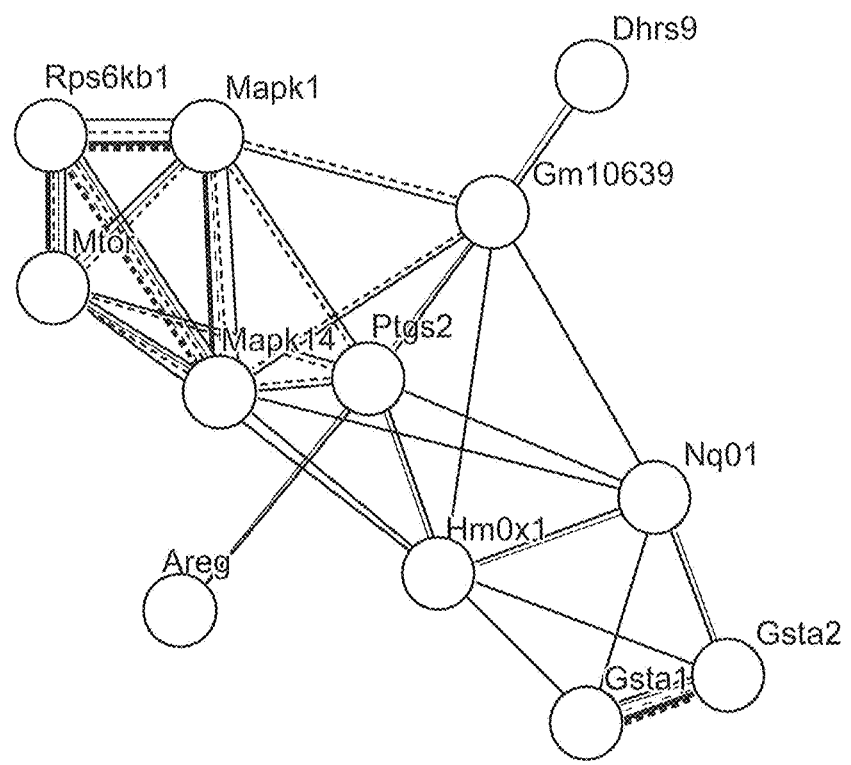

The inventors also checked for differences in pathway activation by protein arrays and Western blot after full repopulation with either shMfap4 or non-targeting control shRNA. Livers were collected and proteins for protein array and Western blot as well as RNA for transcriptomics were isolated (FIG. 8A-8H). Consistently with an enhanced regenerative capacity Mfap4 knockdown induces activation of mTOR, p70S6K, ERK and p38 (FIGS. 8B and 8D). The identified pathways are all linked (FIGS. 8C, 8E and 8K) based on STRING analysis (string-db.org) and impact cell growth and proliferation. P70S6K is a major substrate of mTOR (FIG. 8E) and contributes to liver regeneration. Furthermore, impairments in p70S6K and ERK signaling is linked to the age dependent decline of liver's regenerative capacity. Using the in vitro wound healing assay, double knockout experiments combining the stable shMfap4 or shCTRL expressing cell lines with siRNAs targeting either p70s6k or p38 (FIG. 8F-8G) were conducted. A slowdown in wound healing under such conditions was detected. This puts the knockdown of Mfap4 in line with enhancing regeneration and rejuvenating the liver. Principal component analysis for AML12-shMfap4.1356, AML12-shMfap4.760, and AML12-shNC shows cluster separation between experiment (shMfap4) and control (shNC). A heatmap comparison of Mfap4 and control indicates that genes known to be involved in liver regeneration according to the literature, such as Ptgs2, Areg, Dhrs9, Hmox1 and Nqo1, are upregulated after Mfap4 knockdown compared to control (FIG. 8H-8J). Furthermore, string analysis shows that the transcriptomic pathways coming from the cell line as well as the proteomic identified pathways from the repopulated liver are connected (FIG. 8K).

Figure 9A:
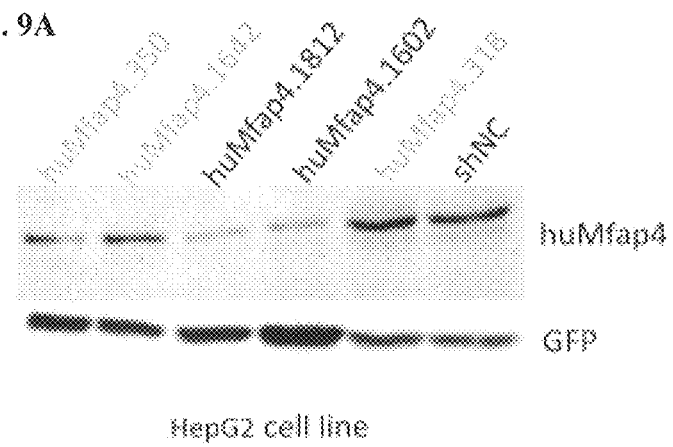
FIG. 9A, 9B, 9C, 9D, 9E, 9F, 9G, 9H, 9I, 9J, 9K, 9L, 9M, 9N, 9O: Mfap4 effect is conserved in human cells FIG. 9A) shRNAs were identified that efficiently targeting human Mfap4. Knockdown test by Western blot analysis using whole-cell lysates. HepG2 cells with stable expression of indicated shRNAs targeting human Mfap4 were generated by retroviral infection and selection. Tubulin serves as a loading control.
Figure 9B:
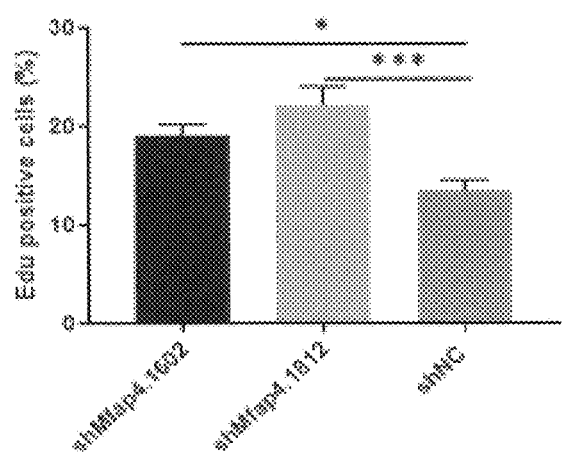
Figure 9C:
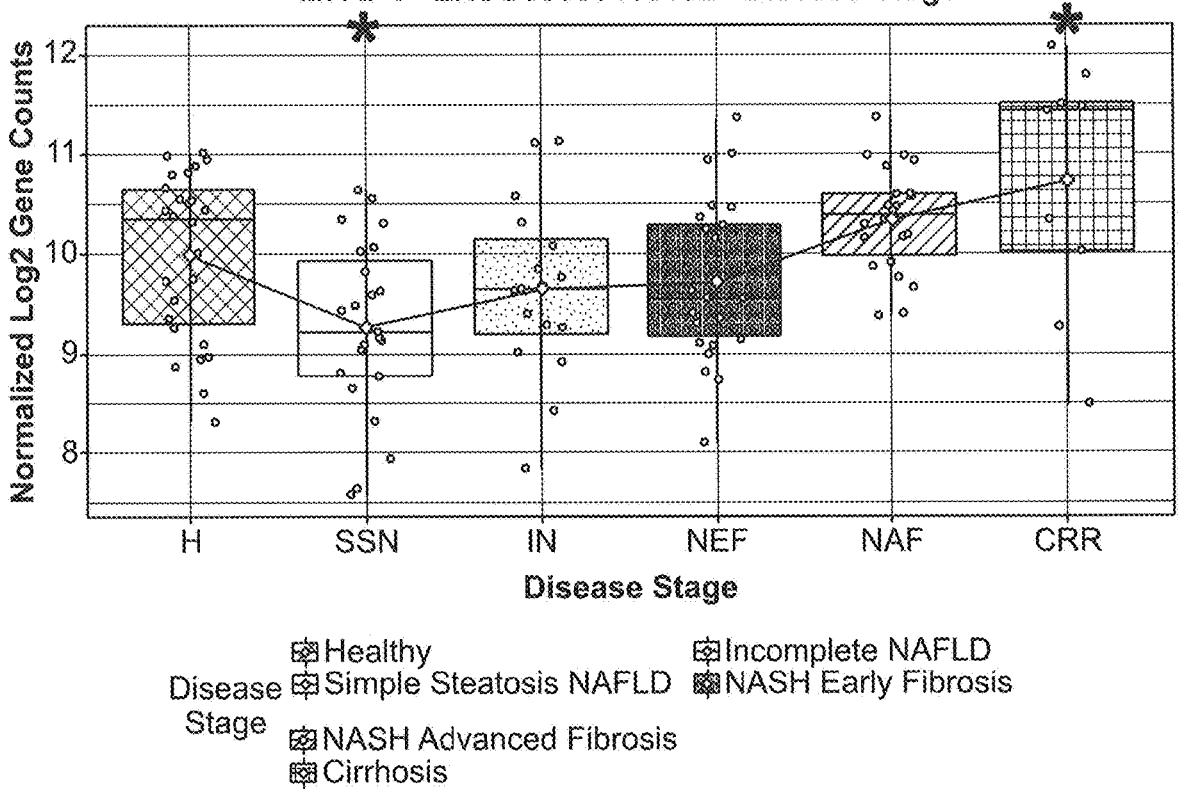
Figure 9D:
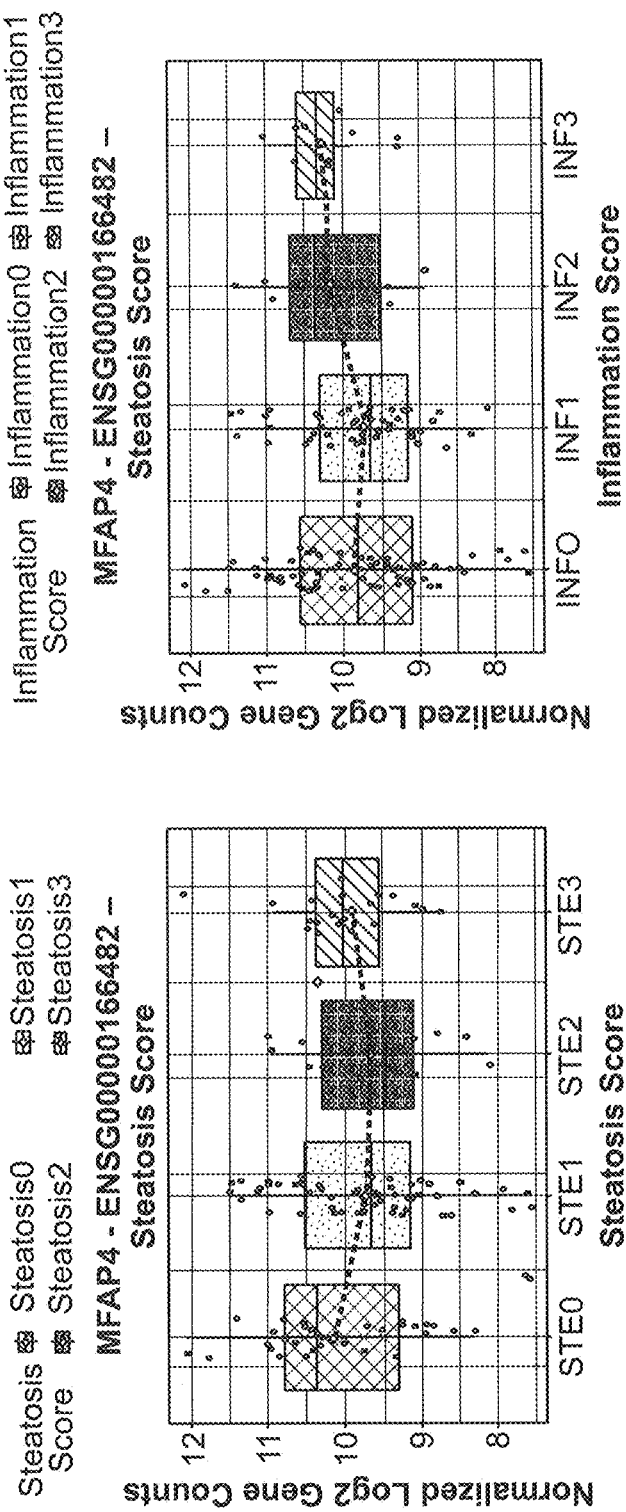
Figure 9E:
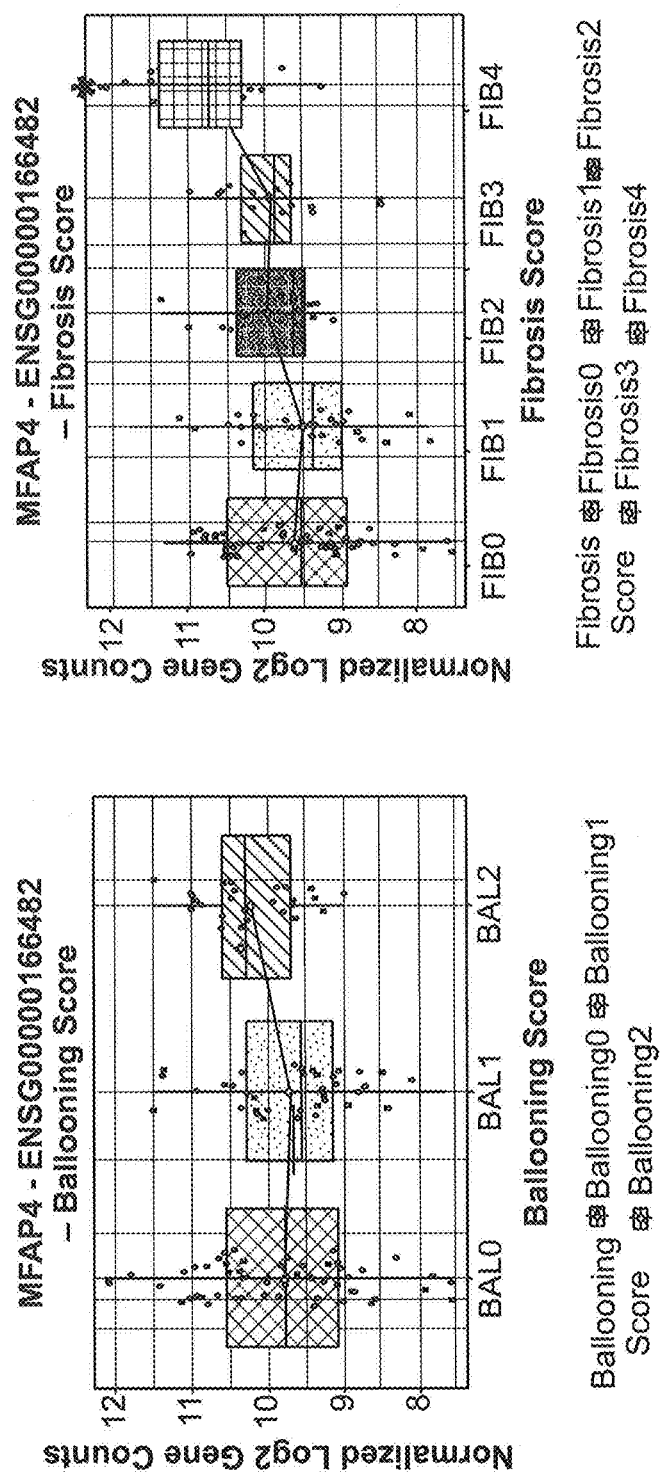
Figure 9F:
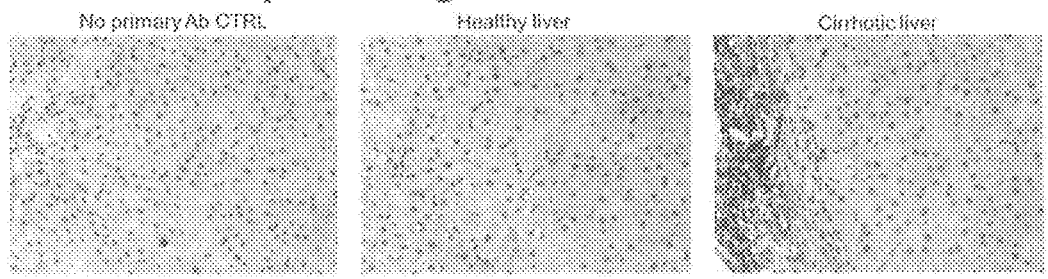
Figure 9G:
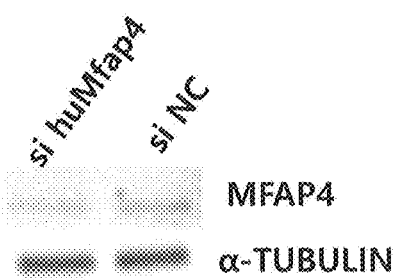
Figure 9H:
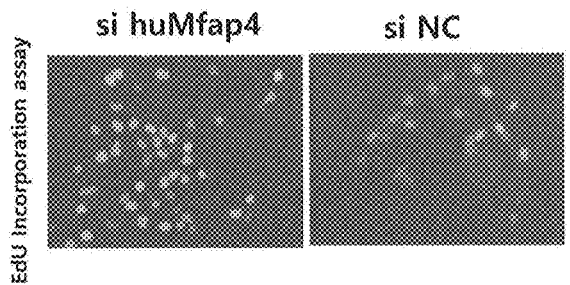
Figure 9I:
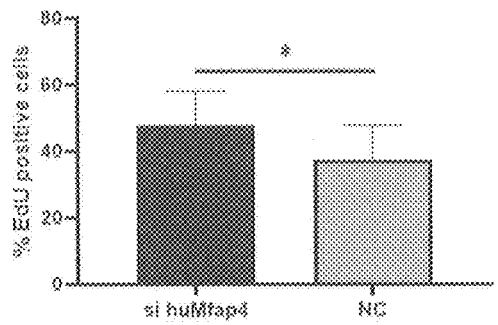
Figure 9J:
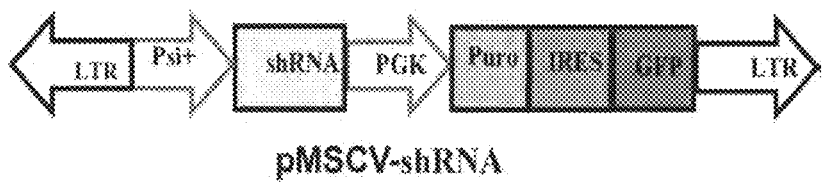
Figure 9K:
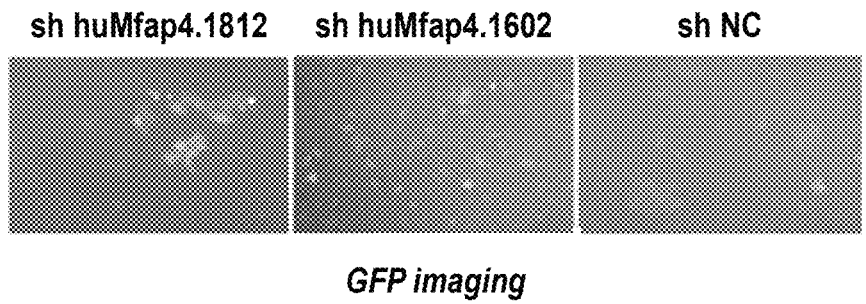
Figure 9L:
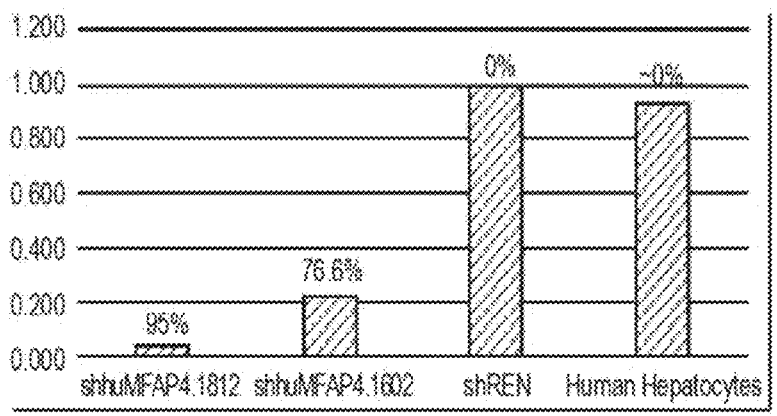
Figure 9M:
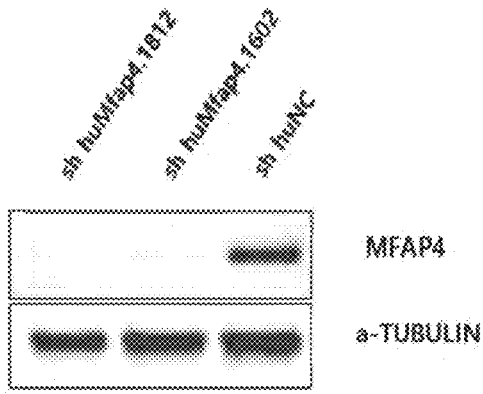
Figure 9N:
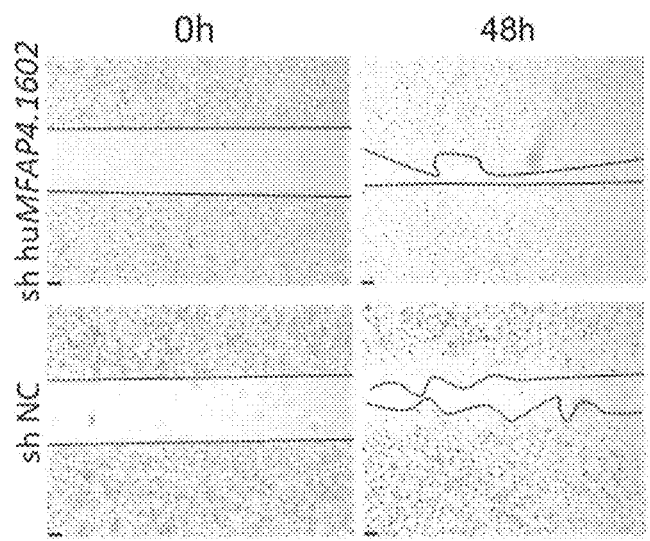
Figure 9O:
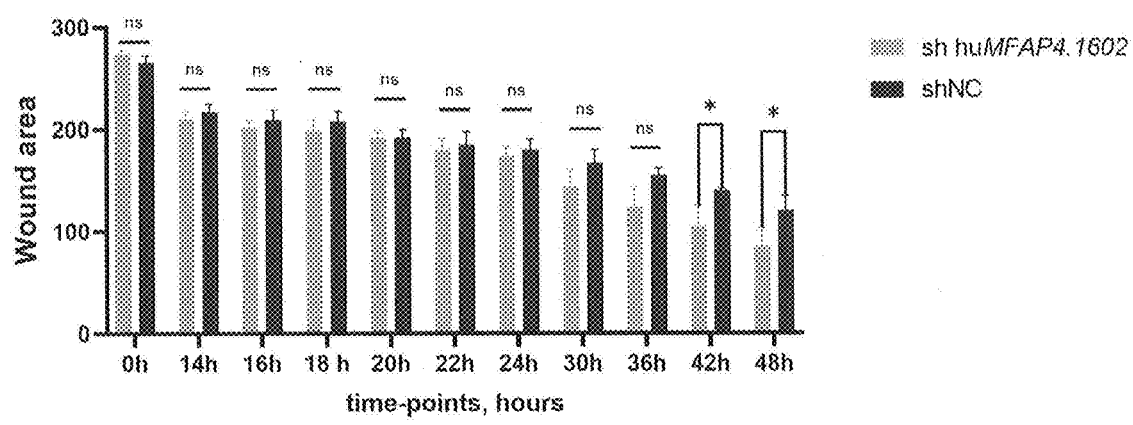

The inventors then identified 2 independent shRNAs targeting human Mfap4: huMfap4.1812 (SEQ ID NO: 7100) and huMfap4.1602 (SEQ ID NO: 7097). Efficient knockdown in the human liver cancer cell line HepG2 (FIG. 9A) was observed. Furthermore, both shRNAs show a strong on-target knockdown of huMfap4 compared to non-targeting control as determined by qPCR analysis (FIG. 9K) and Western blot (FIG. 9L) in immortalized human hepatocytes-SV40 (FIG. 9I-9J). Edu incorporation assay indicates a conserved mechanism between mouse and human, as higher EdU incorporation in human HepG2 cells with Mfap4 knockdown was seen (FIG. 9B), transient knockdown of Mfap4 by siRNA in immortalised human hepatocytes shows higher EdU incorporation (FIG. 9G-9H), and stable knockdown of Mfap4 in immortalised human hepatocytes enhances wound healing (FIG. 9M-9N).

Importantly expression of Mfap4 in the liver increases in NAFLD patients with cirrhosis (FIG. 9C-9D), based on a local patient cohort. This is consistent with previous studies indicating increased Mfap4 in liver and lung fibrosis. Interestingly, Mfap4 was suggested as potential biomarker for non-invasive assessment of hepatic fibrosis in hepatitis C patients. Staining for Mfap4 of human liver tissue from healthy and cirrhotic liver done by the inventors also showed increased detection in the diseased liver. Interestingly beside strong staining in fibrotic scar areas Mfap4 was also detected in the cytoplasm and nucleus of hepatocytes (FIG. 9E). Mfap4 is thought to be an extracellular matrix protein but not much is known about its role in hepatocytes. It represents therefore a new target for liver disease therapy, with new biology.

Figure 28A:
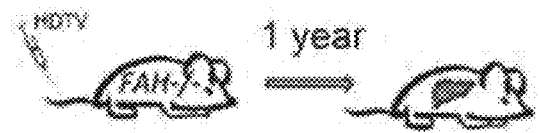
FIG. 28A, 28B, 28C, 28D, 28E: Mfap4 knockdown for 1 year does not lead to liver cancer FIG. 28A) Schematic representation of the experiment. FAH−/− mice were injected with p/T-FAHIG-shRNA & SB13 expressing constructs via HDTV; then, mice were kept for 1 year to observe any tumor formation or abnormal liver histology.
Figure 28B:
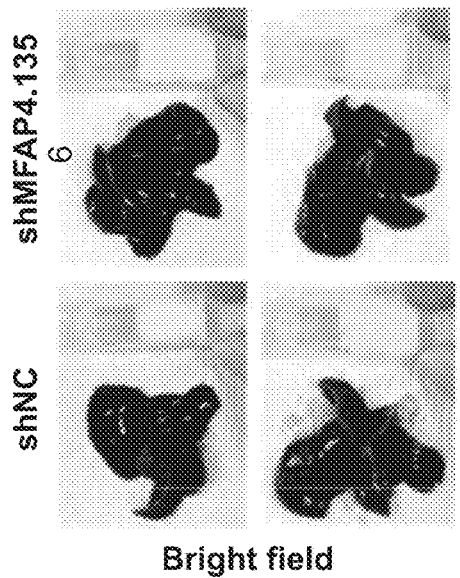
Figure 28C:
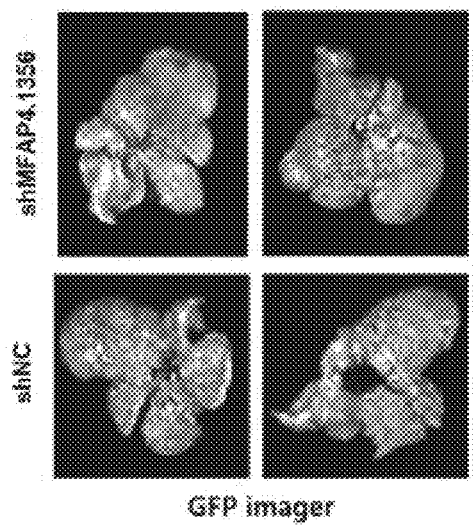
Figure 28D:
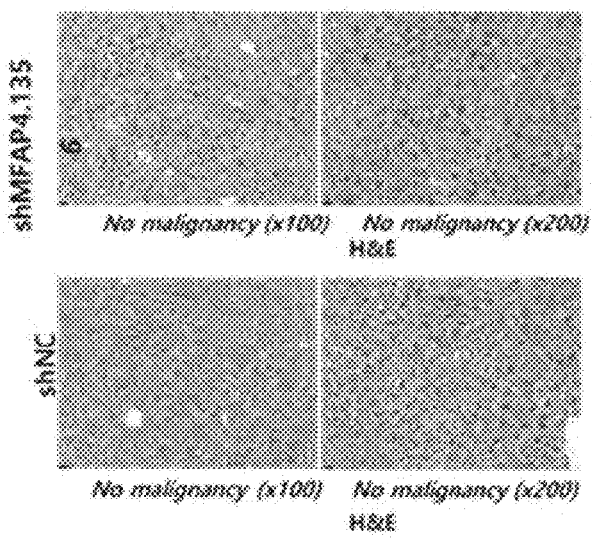
Figure 28E:
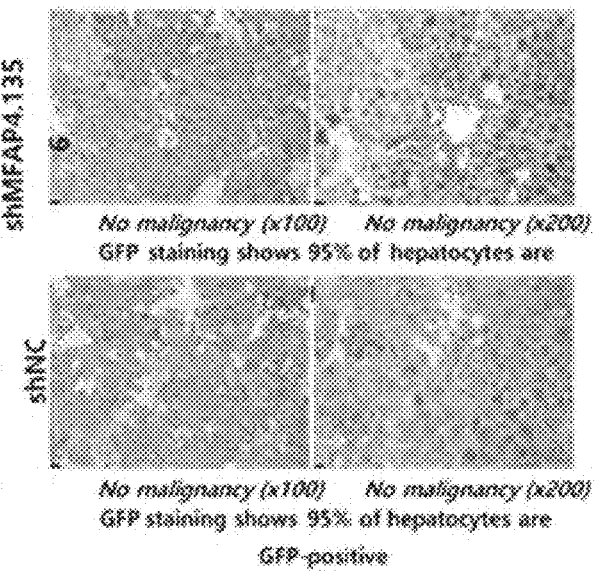

The inventors also investigated the development of liver cancer in Mfap4 treated mice. shMfap4 constructs were delivered by HDTV to FAH−/− mice. After keeping mice for 1 year, livers were harvested to determine any tumor formation in the liver (FIG. 28A). No GFP-positive tumor is observed and livers are fully repopulated as indicated by a strong GFP-positive signal (FIGS. 28B-28C and 28E). Around 95% of hepatocytes are GFP-positive. Also, Hematoxylin & Eosin staining did not reveal any malignant disease in both the shMfap4 and shNC treated group. Certified pathologists who conducted the evaluation did not find malignant lesions in the liver (FIG. 28D). The experiments show that Mfap4 knockdown for 1 year does not lead to liver cancer in mice.

Figure 29A:
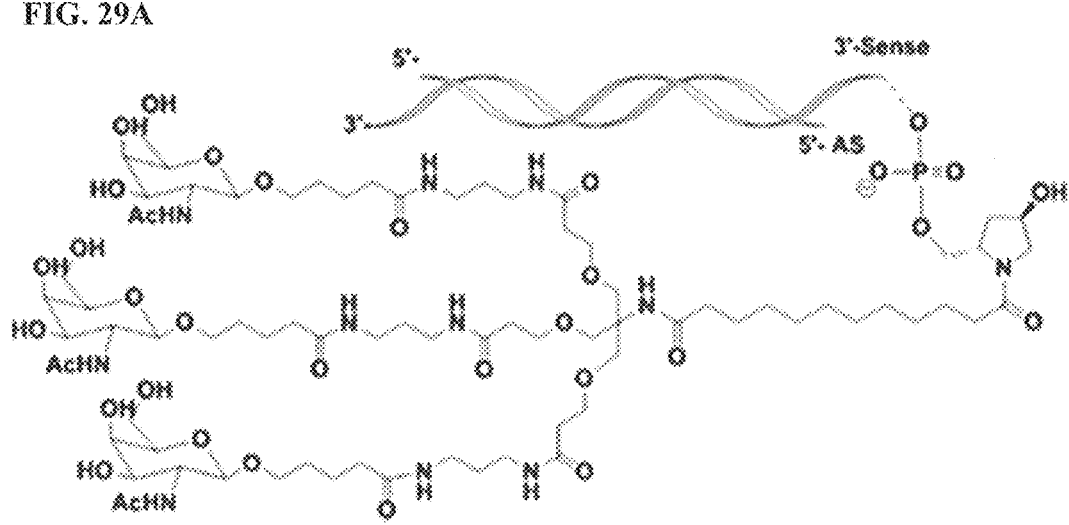
FIG. 29A, 29B, 29C: GalNAC conjugates with siRNA against Mfap4 (BNL CL.2 cell line; 72 h post-transfection) FIG. 29A) Structure of GalNAC-siRNA conjugate used in studies. Exact backbone modifications can be found in the sequence appendix (SEQ ID NOs: 7092 and 7093). The target sequence for the siRNA was based on the shRNA guide sequence.
Figure 29B:
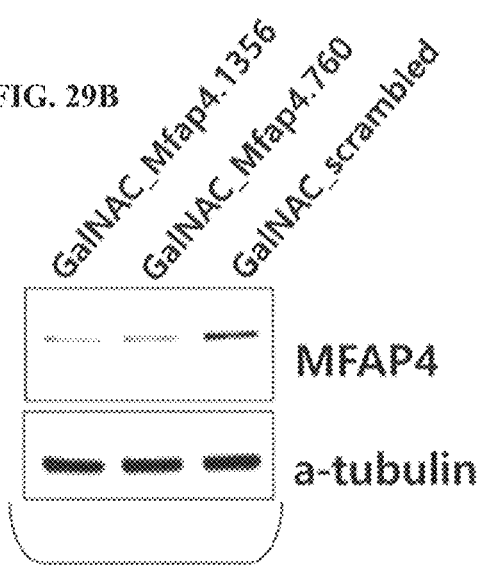
Figure 29C:
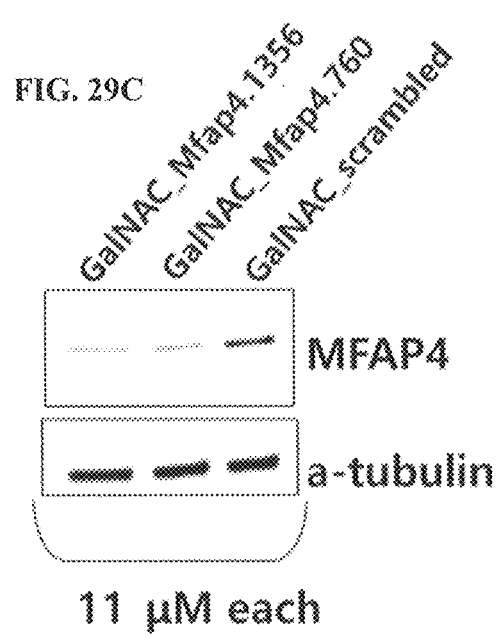

Modified siRNA-GalNAC conjugates targeting Mfap4 were generated (FIG. 29A; Table 11; SEQ ID NOs: 7092 and 7093). Human immortalised hepatocytes were treated for 72 h with siRNA and were then exposed for 4 h to EdU, then fixed and analysed. Western blot analysis with shows efficient knockdown of Mfap4 by two different conjugates GalNAC-si Mfap4.1356 and GalNAC-si Mfap4.760 compared to scrambled control.

Grhpr—Glyoxylate and Hydroxypyruvate Reductase

Figure 10A:
FIG. 10A, 10B, 10C, 10D: In vitro validation of targeting Grhpr for enhancing regeneration FIG. 10A) Outline of retroviral backbone for generating stable cell lines.
Figure 10B:
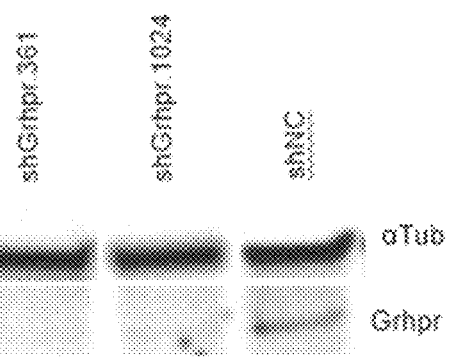
Figure 10C:
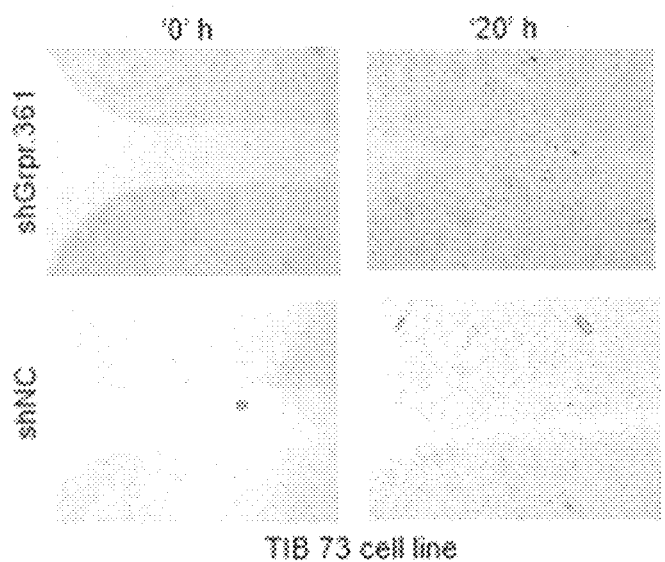
Figure 10D:
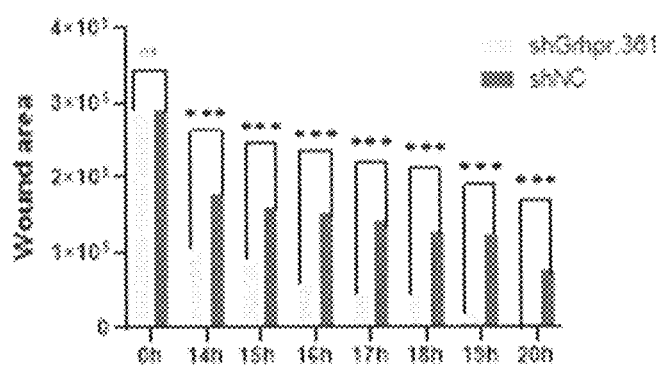
Figure 12A:
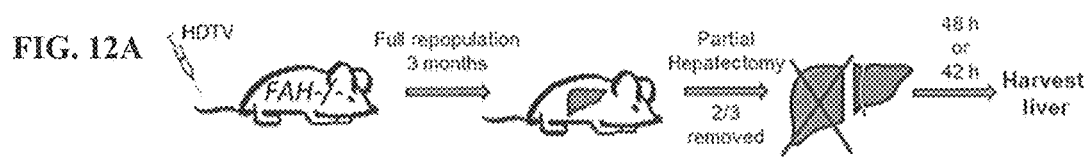
FIG. 12A, 12B, 12C, 12D: Grhpr knockdown accelerates liver regeneration after partial hepatectomy FIG. 12A) Experimental outline. FAH−/− mice were injected with our constructs, then, mice were kept for full repopulation for 3 months. After that ⅔ of the liver was surgically removed. The remaining regenerating liver was harvested at different time points after surgery.
Figure 12B:
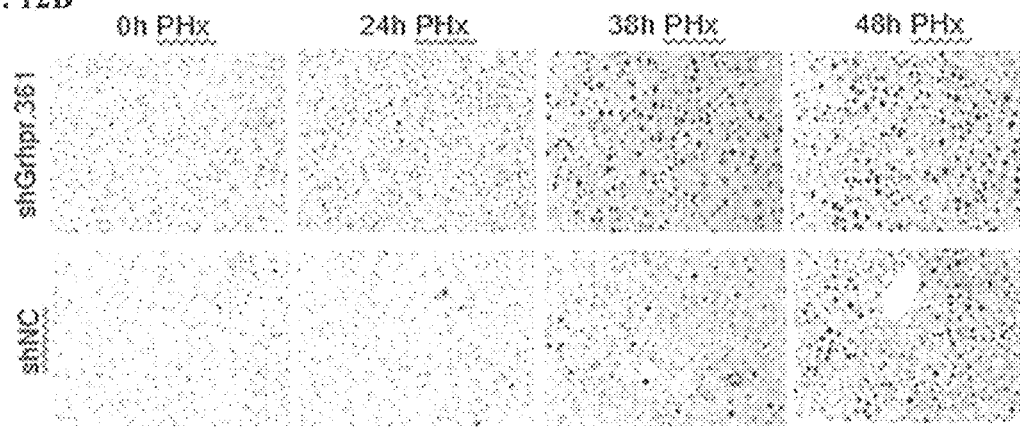
Figure 12C:
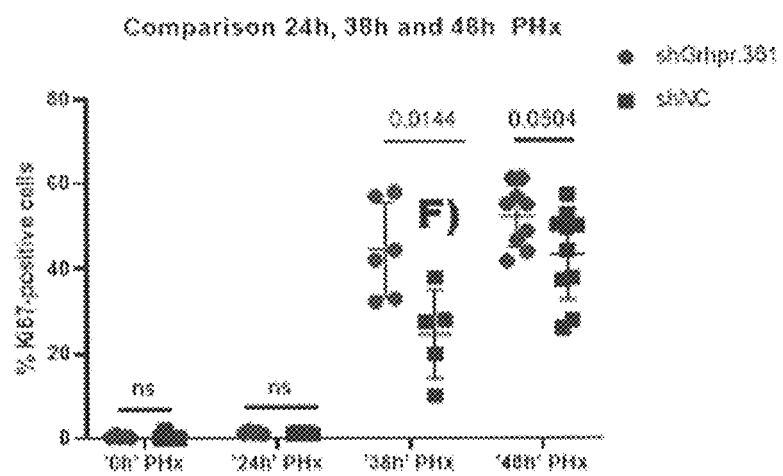
Figure 12D:
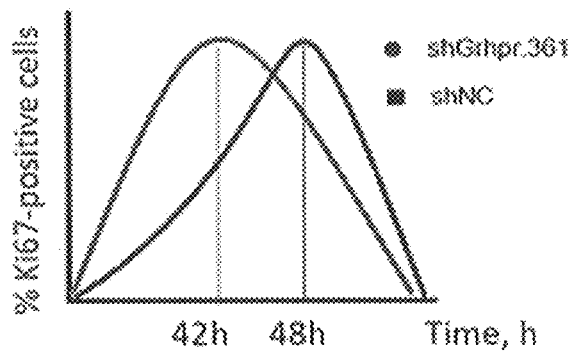
Figure 13A:
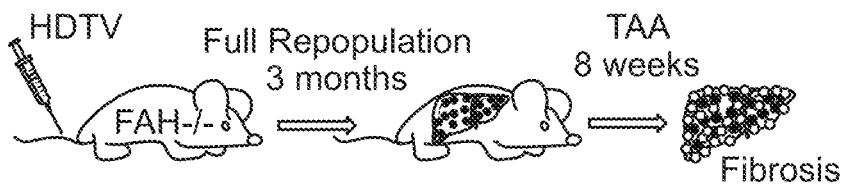
FIG. 13A, 13B, 13C, 13D: Grhpr knockdown attenuates chronic liver damage related liver fibrosis FIG. 13A) Experimental outline. FAH−/− mice were injected with our constructs, then, mice were kept for full repopulation for 3 months. After that chronic liver damage was induced by repetitive doses of thioacetamide administered intraperitoneal 3 times per week for 8 weeks. Livers were harvested, processed and analyzed.
Figure 13B:
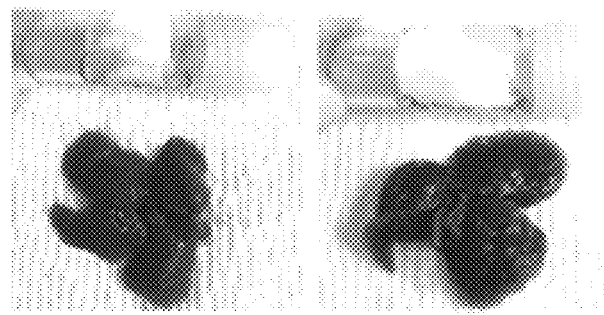
Figure 13C:
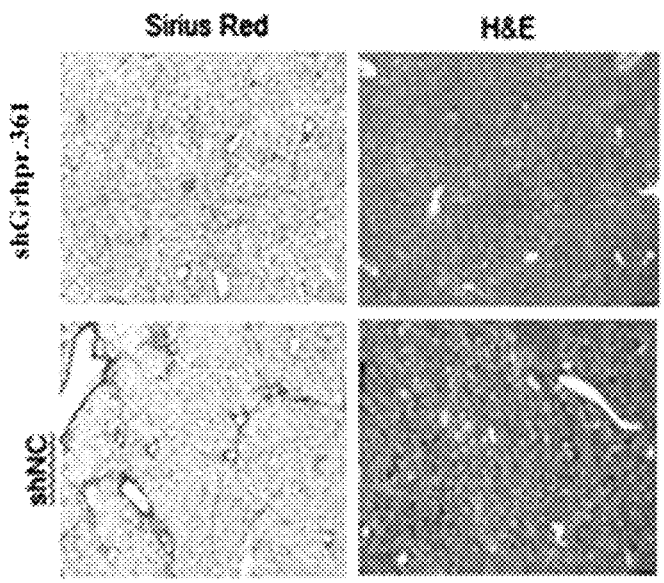
Figure 13D:
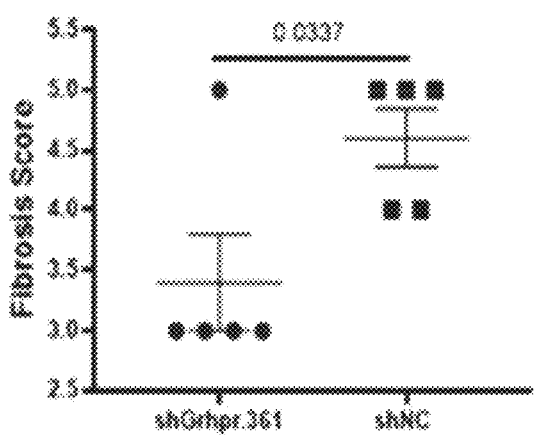
Figure 14A:
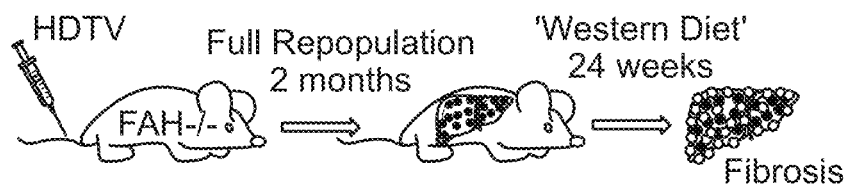
FIG. 14A, 14B, 14C, 14D: Grhpr knockdown does not protect against NASH related liver fibrosis FIG. 14A) Experimental outline. FAH−/− mice were injected with our constructs, then, mice were kept for full repopulation for 3 months. After full repopulation was reached mice were exposed to the "Western Diet" (high fat diet and 60% fructose) for 24 weeks. Livers were harvested, processed and analyzed.
Figure 14B:
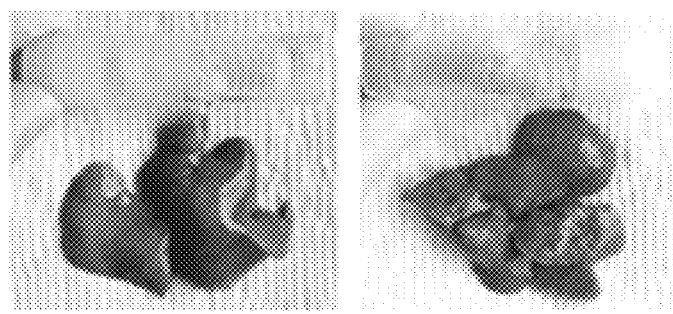
Figure 14C:
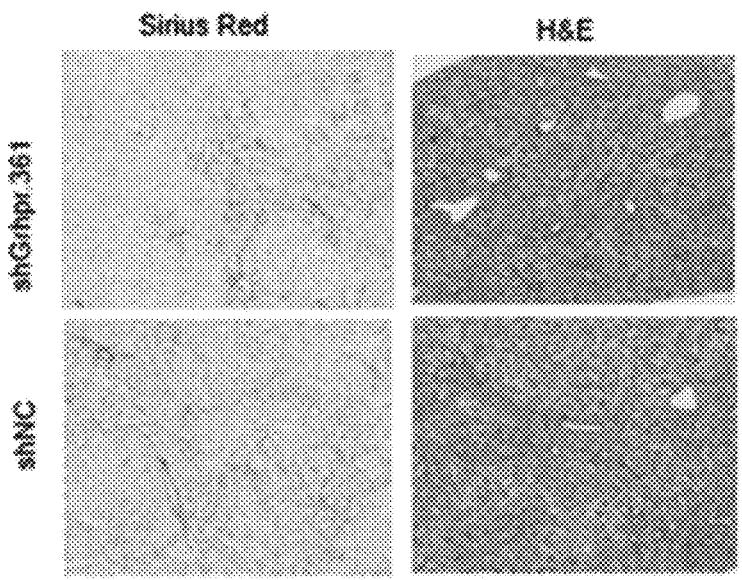
Figure 14D:
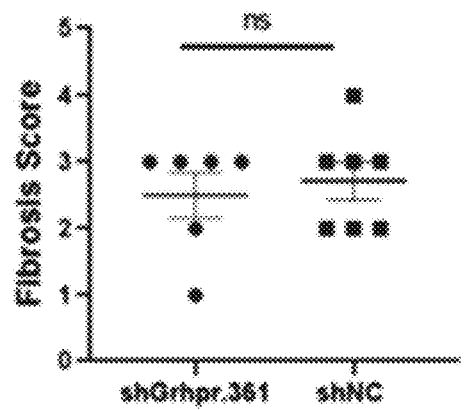

The second identified target is an enzyme with hydroxylpyruvate reductase, glyoxylate reductase and D-glycerate dehyrdrogenase enzymatic activities. Two shRNAs targeting Grhpr were strongly enriched in the screen (FIG. 1A-1D). Validation followed the same way as was described for Mfap4. First, stable cell lines were generated and the knockdown efficiency of the shRNAs was determined (FIG. 10A-10B). Both shRNAs show a strong on-target knockdown. The wound healing assay supported a faster healing and faster proliferation under Grhpr knockdown condition (FIG. 10C-10D). Again, taking advantage of the FAH−/− mice, repopulation between Grhpr targeting and control shRNA was compared. Grhpr knockdown accelerates liver repopulation under these conditions and all shGrhpr injected mice still survive at a 1:30 dilution whereas all control shNC injected mice die (FIG. 11A-11G). Next, the liver was completely repopulated so that every hepatocyte expresses shGrhpr or a non-targeting control shRNA (FIG. 12A). In the acute liver damaging model of ⅔ partial hepatectomy, Grhpr knockdown accelerates regeneration indicated by the earlier peak of Ki67 positive cells (FIG. 12B-12D). Furthermore, applying chronic TAA treatment to shGrhpr expressing repopulated FAH−/− mouse liver showed reduced liver injury and reduced fibrosis compared to control (FIG. 13A-13D). However, Grhpr knockdown does not seem to protect against NAFLD related disease progression and fibrosis development in the Western Diet mouse model (FIG. 14A-14D).

Figure 15A:
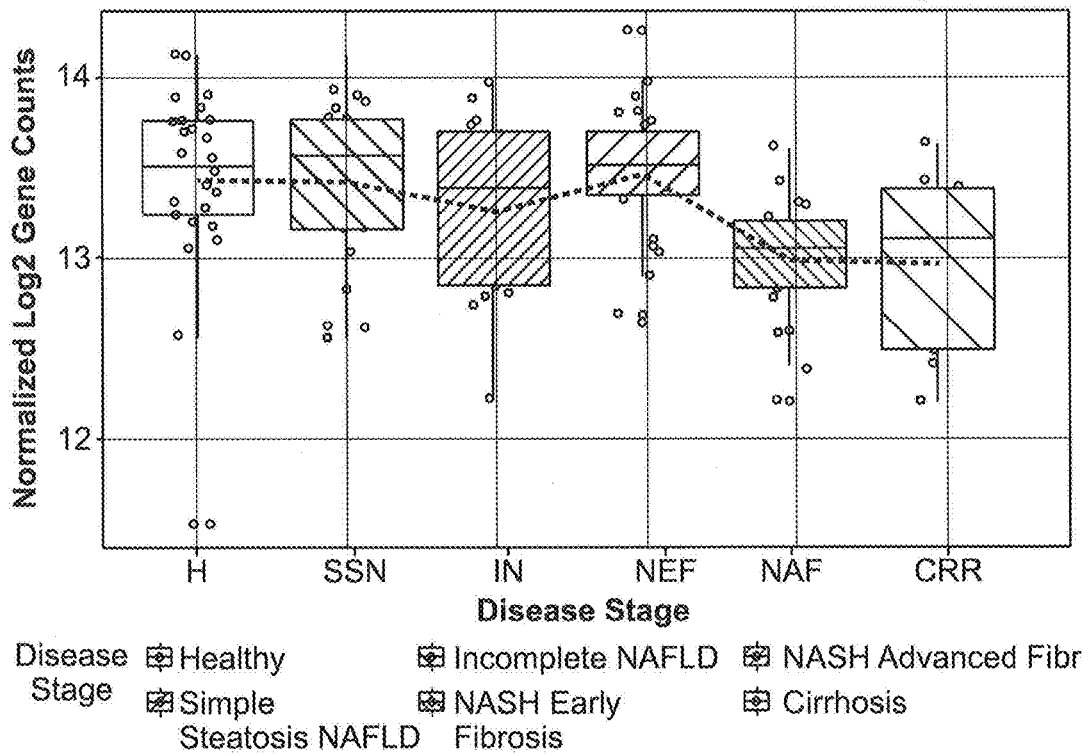
FIG. 15A, 15B, 15C: Grhpr expression changes in human NAFLD A) Transcriptomic analysis of liver samples from ~150 patients shows slight but significant decrease in Grhpr expression in NASH patients with advanced fibrosis and cirrhosis. Consistent with this we detected a significant reduction in patients with fibrosis 3 and 4 score (*$p<0.05$, $p<0.01$, *$p,0.005$).
Figure 15B:
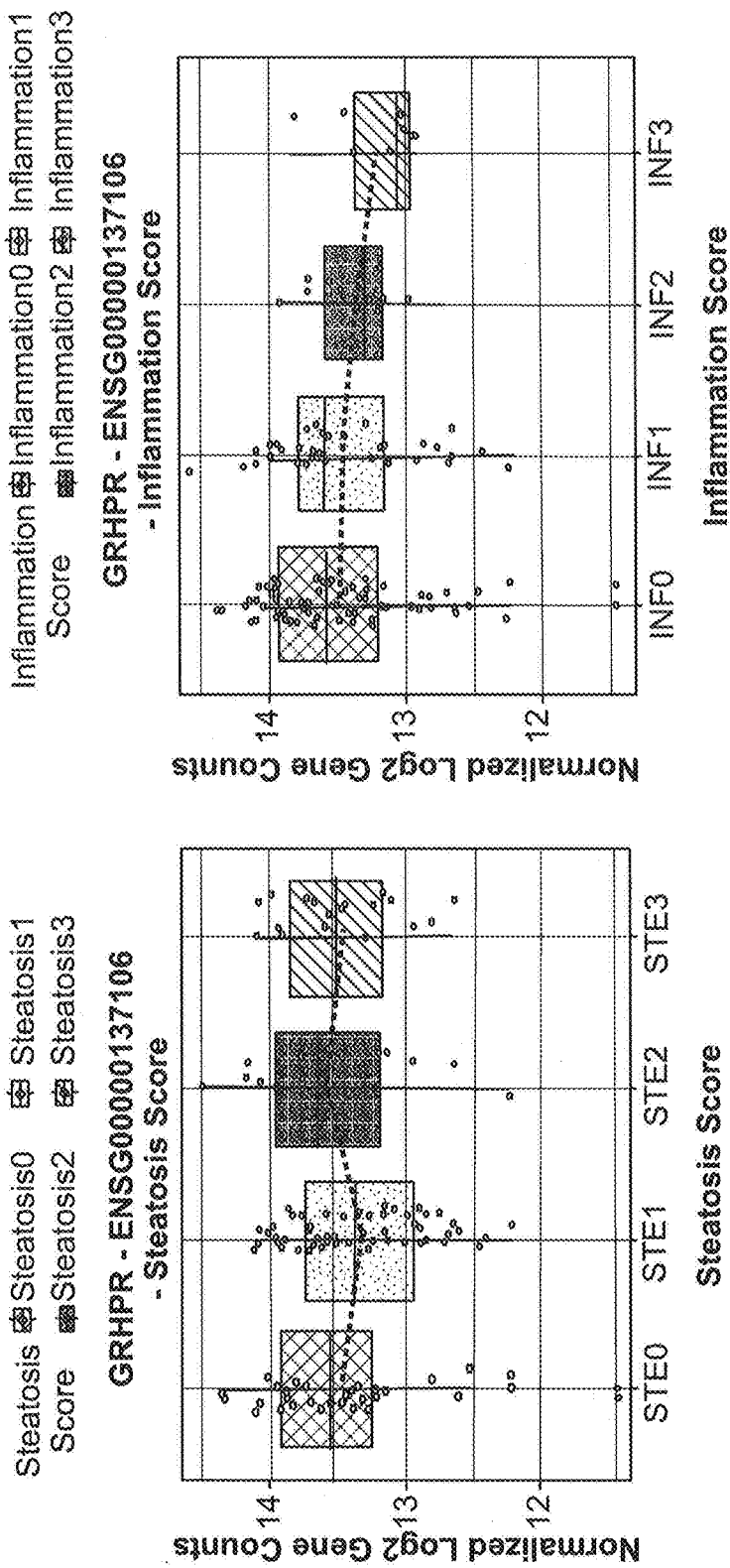
Figure 15C:
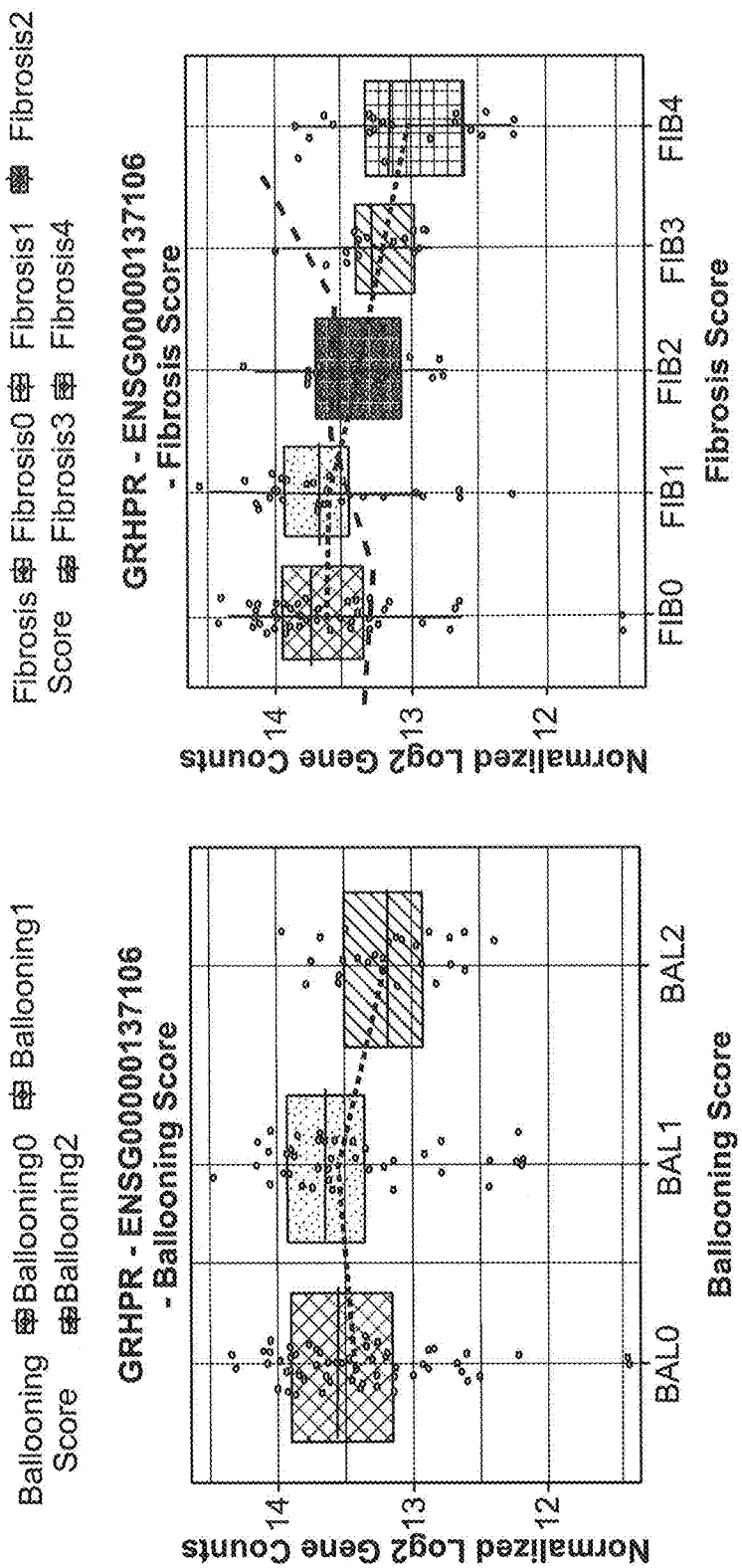

Interestingly, the NAFLD patient cohort showed a significant reduction in Grhpr expression in the liver at NASH advanced fibrosis and cirrhosis stages, but not very strongly (FIG. 15A-15C).

Figure 31A:
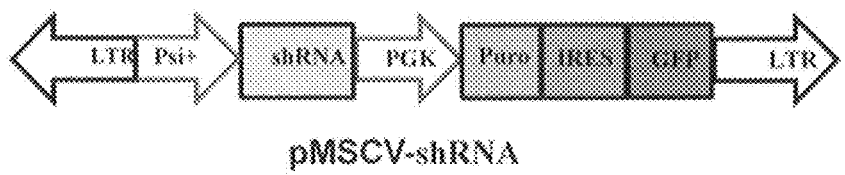
FIG. 31A, 31B, 31C: Grhpr expression in human hepatocytes (HpG2 cell line) FIG. 31A) Scheme of retroviral backbone for generating stable cell lines.
Figure 31B:
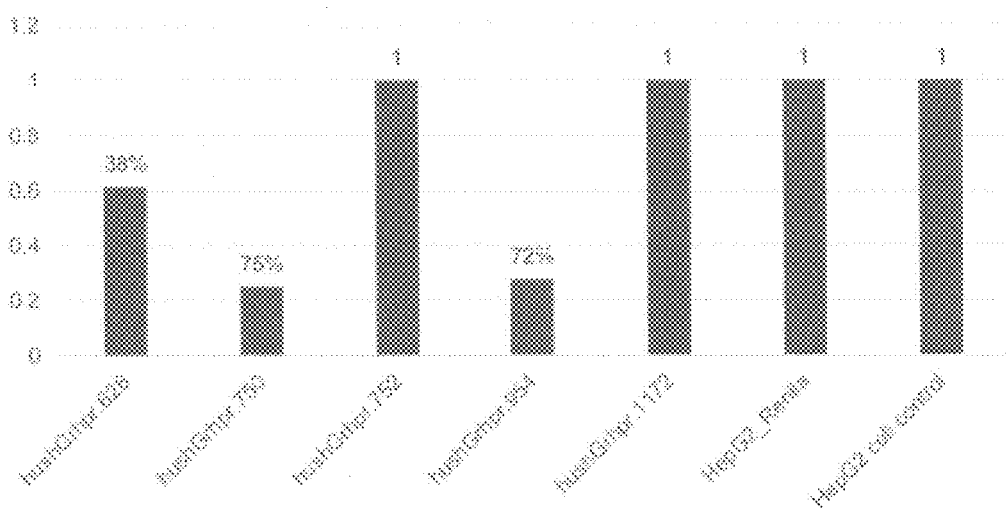
Figure 31C:
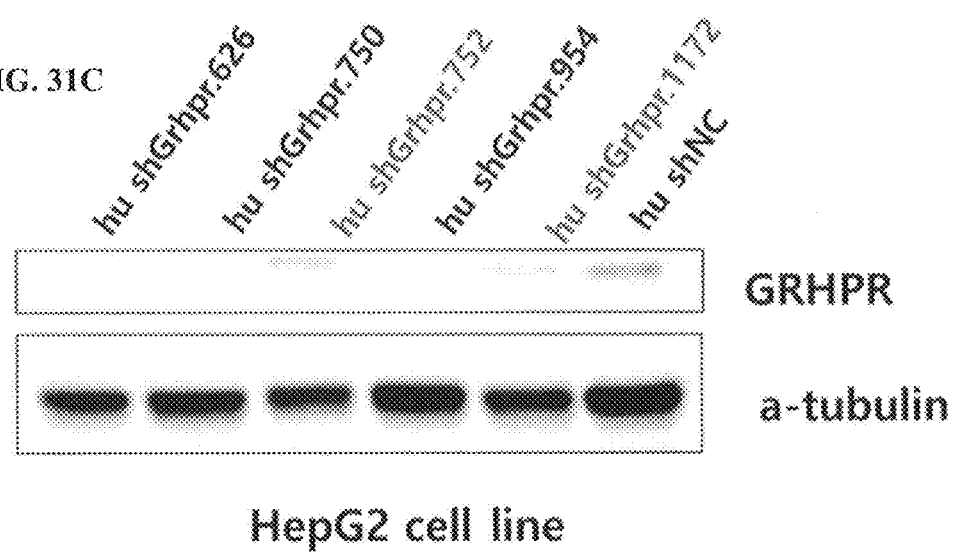

Similar to the experimental set up for targeting Mfap4, the development of liver cancer was investigated under Grhpr knockdown conditions (FIG. 30A). FAH−/− mice were injected with a combination of p?T-FAHIG-shGrhpr and SB13 plasmids for liver repopulation. Initially 5 to 10% of hepatocytes will have stable integration. After NTBC drug withdrawal after injection the liver will be repopulated, so that nearly every hepatocyte will express the shRNA targeting Grhpr. 1 year after injection livers were harvested and evaluated for liver tumor development. No GFP-positive tumor were observed in FAH−/− mice, and livers are fully repopulated (FIG. 30B-30C), indicating that long term Grhpr knockdown in the liver does not induce liver cancer and is safe Furthermore, HepG2 cells with stable expression of shRNAs were generated by retroviral transfection and selection (FIG. 31A). Grhpr knockdown was determined by qPCR and Western blot using RNA or whole-cell lysates (Tubulin was used as a loading control). Several independent shRNAs targeting human Grhpr were identified (FIG. 31B) that lead to efficient Grhpr knockdown in the human liver cancer cell line HepG2 (FIG. 31C).

Figure 32A:
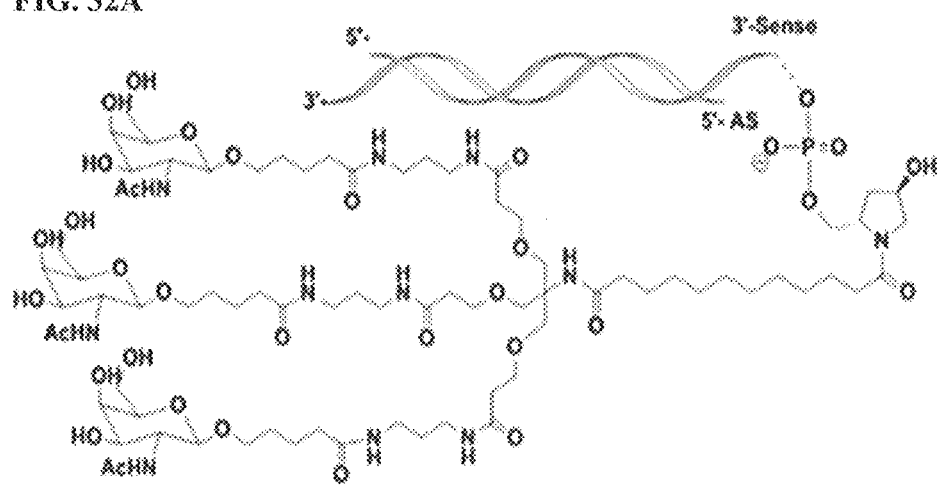
FIG. 32A, 32B: GalNAC conjugates with siRNA against Grhpr (BNL CL.2 cell line; 72 h post-transfection) FIG. 32A) Structure of GalNAC-siRNA conjugate used in studies. Exact backbone modifications can be found in the sequence appendix (SEQ ID NO: 7094). The target sequence for the siRNA was based on the shRNA guide sequence.
Figure 32B:
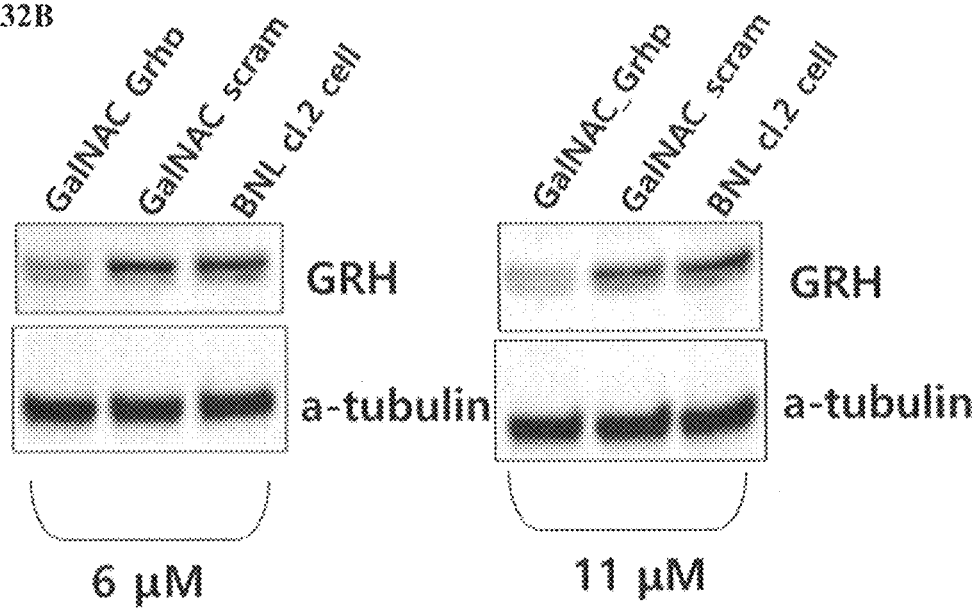

Modified siRNA-GalNAC conjugates targeting Grhpr were generated (FIG. 32A, Table 11; SEQ ID NO: 7094), following the same way as was described for Mfap4. BNL CL.2 cell line; 72 h post-transfection. Western blot analysis with 6 μM and 11 μM, respectively, shows efficient knockdown of Grhpr by conjugate GalNAC-si Grhpr.361 compared to scrambled control.

Itfg1—Integrin Alpha FG-GAP Repeat Containing 1

Figure 16D:
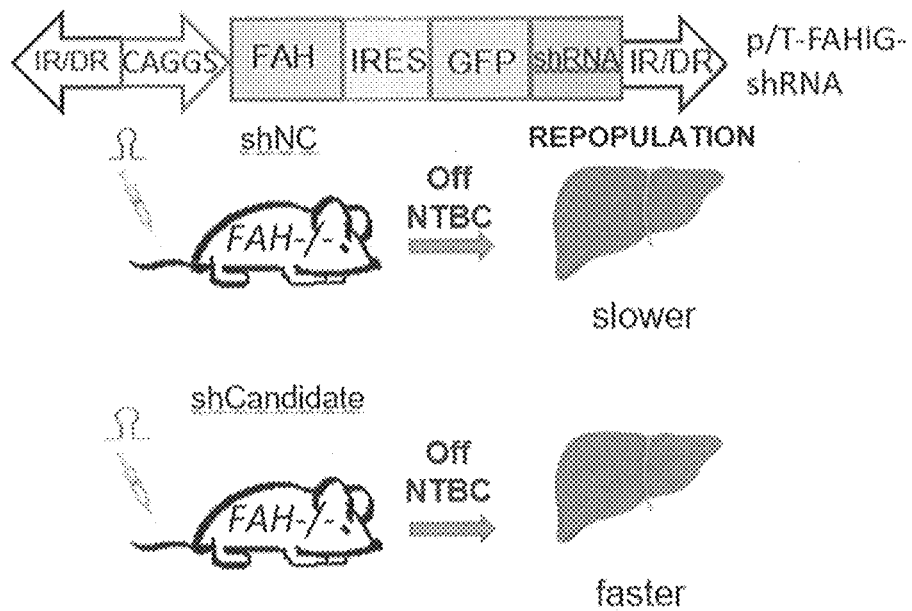
Figure 16E:
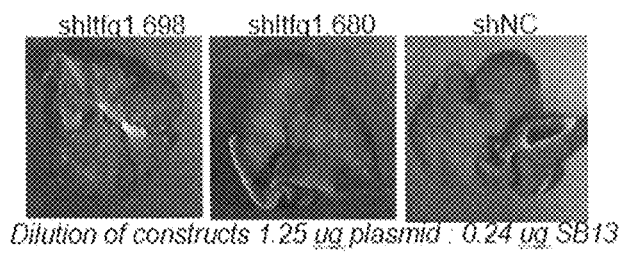
Figure 16F:
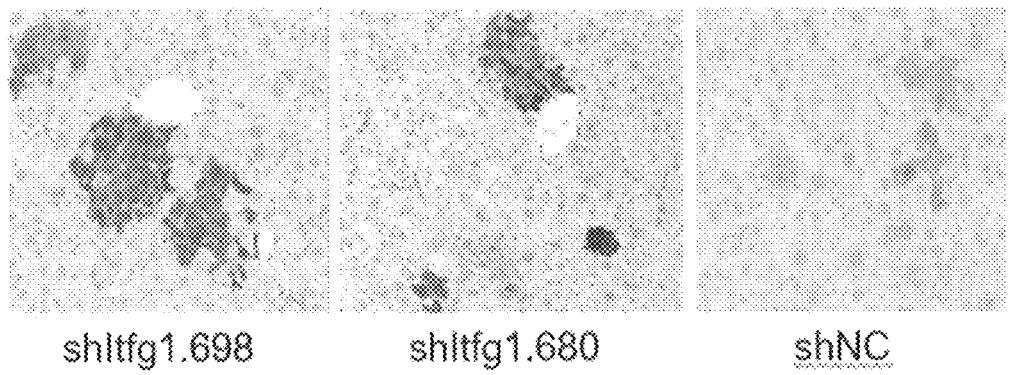
Figure 17A:
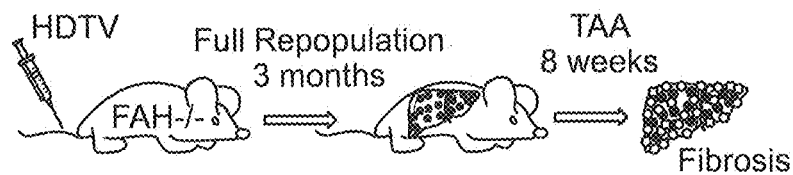
FIG. 17A, 17B, 17C, 17D, 17E: Itfg1 knockdown attenuates chronic liver damage related liver fibrosis FIG. 17A) Experimental outline. FAH−/− mice were injected with our constructs, then, mice were kept for full repopulation for 3 months. After that chronic liver damage was induced by repetitive doses of thioacetamide administered intraperitoneal 3 times per week for 8 weeks. Livers were harvested, processed and analyzed.
Figure 17B:
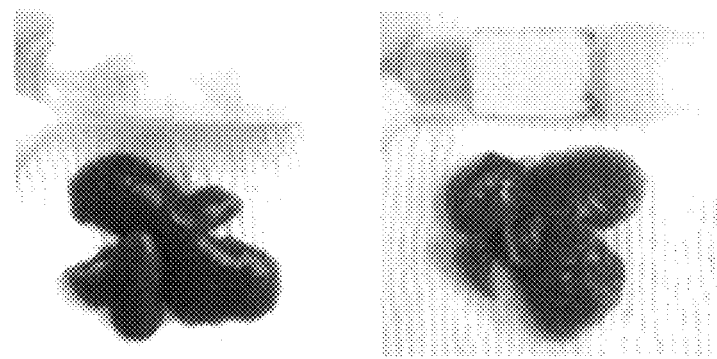
Figure 17C:
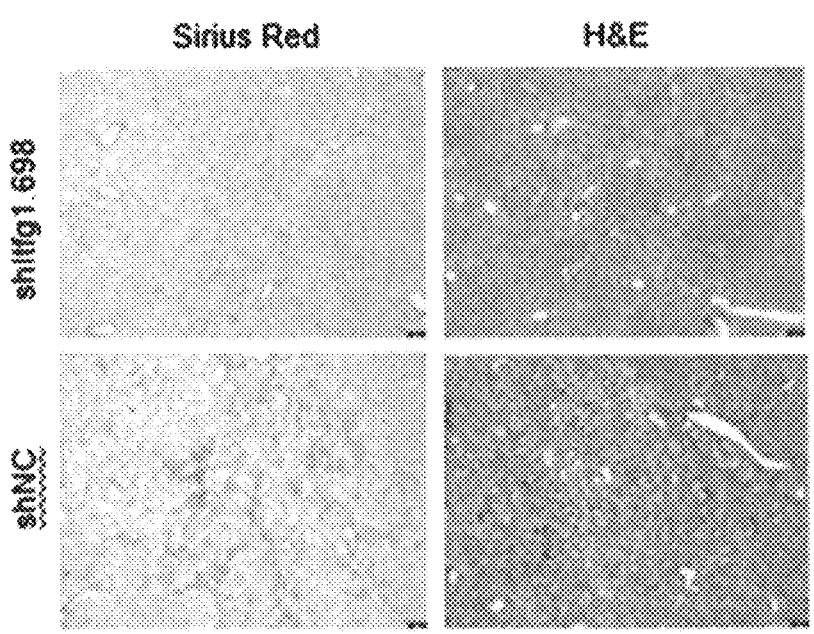
Figure 17D:
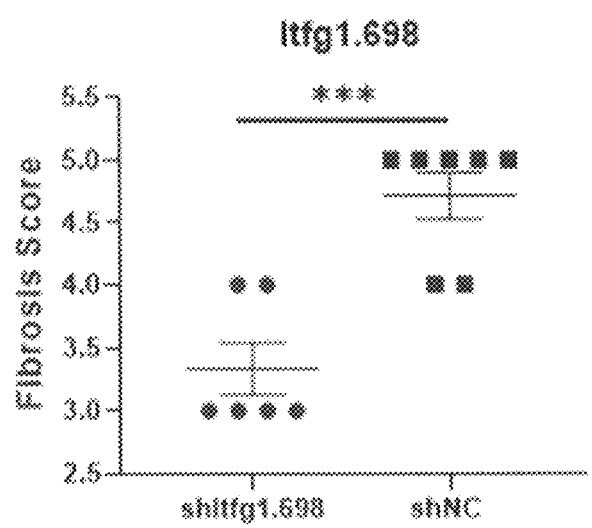
Figure 17E:
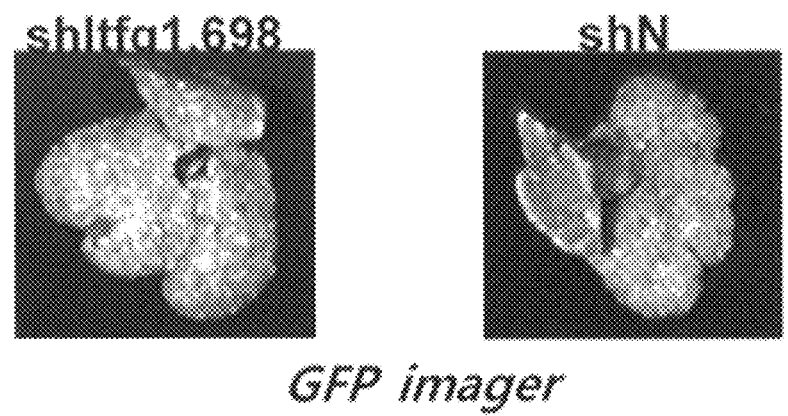

The on-target knockdown efficiency of the top enriched shRNA and an additional independent shRNA were first tested. Both shRNAs show a good on-target knockdown by qPCR and Western blot (FIG. 16A-16B). Itfg1 knockdown strongly accelerates wound healing in vitro, taking advantage of the stable cell lines (FIG. 16C). The inventors then took advantage of the FAH−/− mice and did a repopulation assay (FIG. 16D). Consistent with the screening results, both Itfg1 knockdowns accelerate repopulation (FIG. 16E-16G). Interestingly, if the plasmid input was further diluted, at some point, the amount of hepatocytes with stable integration should be not sufficient to compensate for hepatocyte loss after NTBC withdrawal (FIG. 16H right panel). At a 1:30 dilution still all shItfg1 injected mice survive whereas all shCTRL injected mice die (FIG. 16H left panel). This further supports the Itfg1 knockdown mediated acceleration, as only in case of shItfg1 the hepatocytes expand fast enough to compensate for hepatocyte loss. Consistent with this, after full liver repopulation, a protective effect of Itfg1 knockdown against chronic TAA induced liver damage and fibrosis (FIG. 17A-17E) was seen.

Figure 18A:
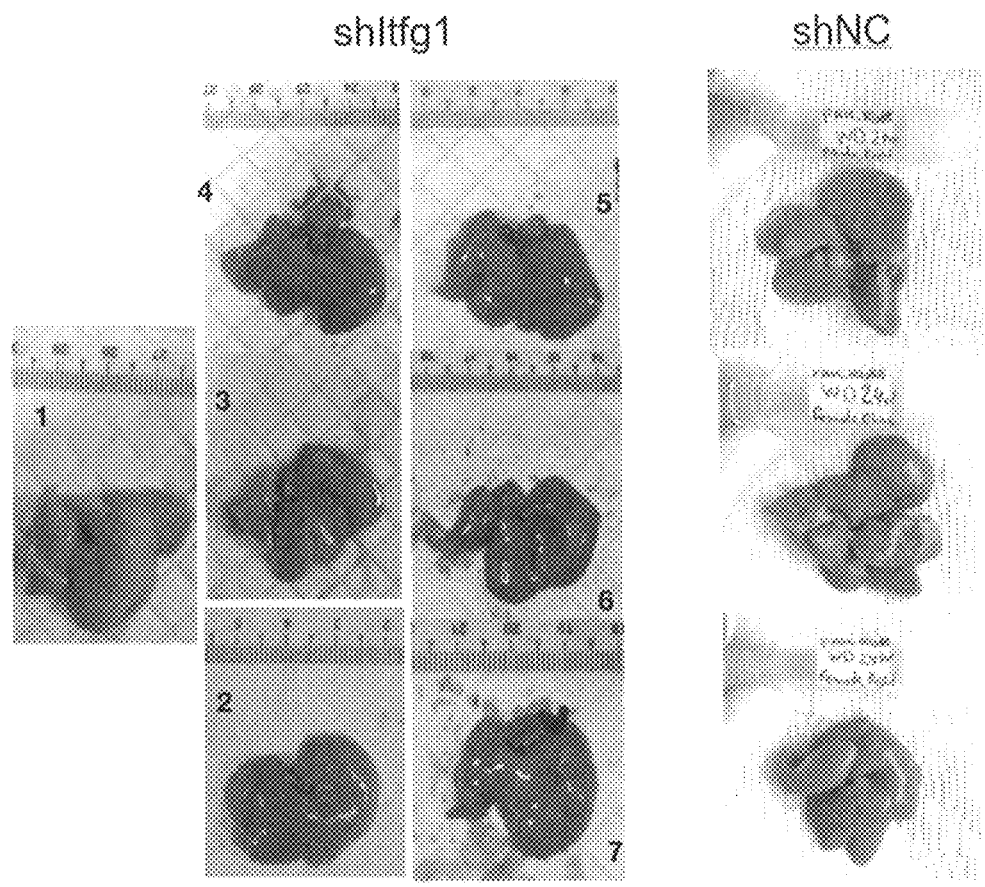
Figure 18C:
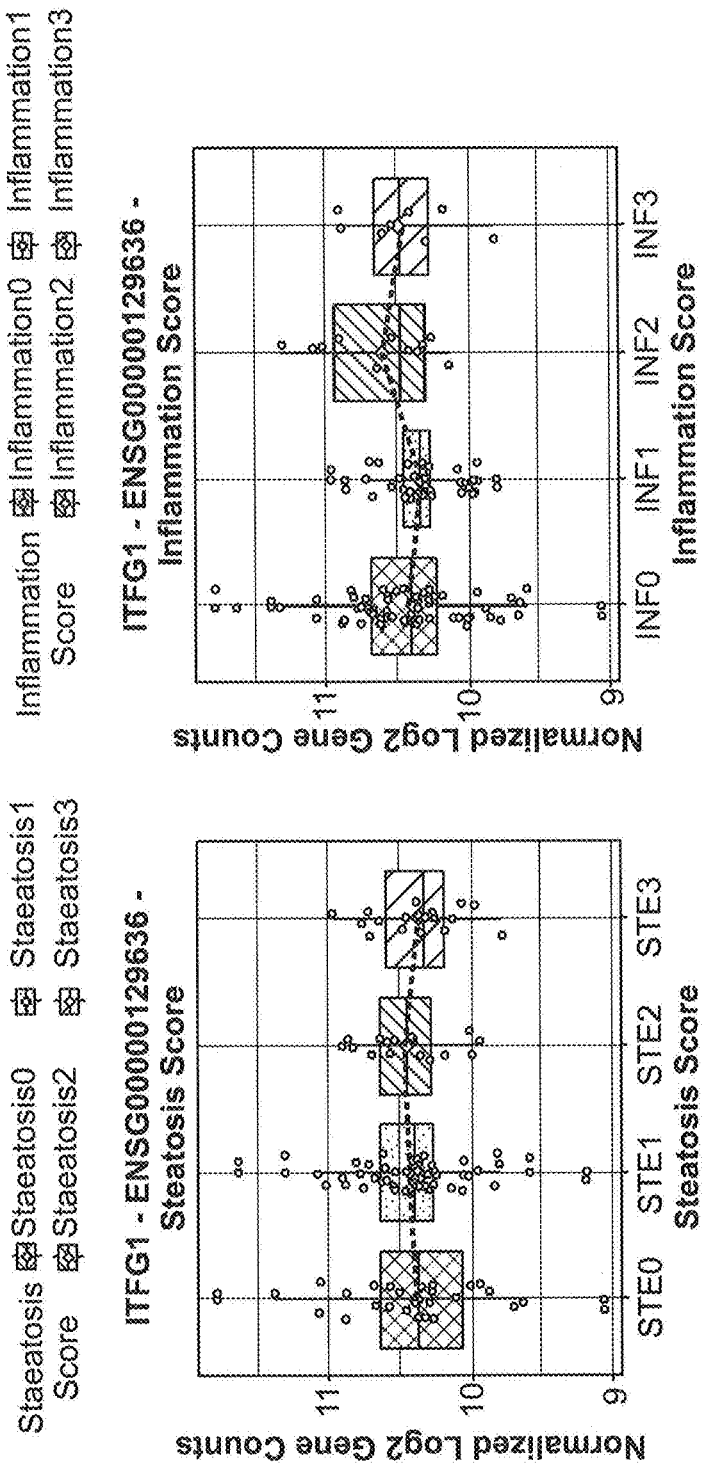
Figure 18D:
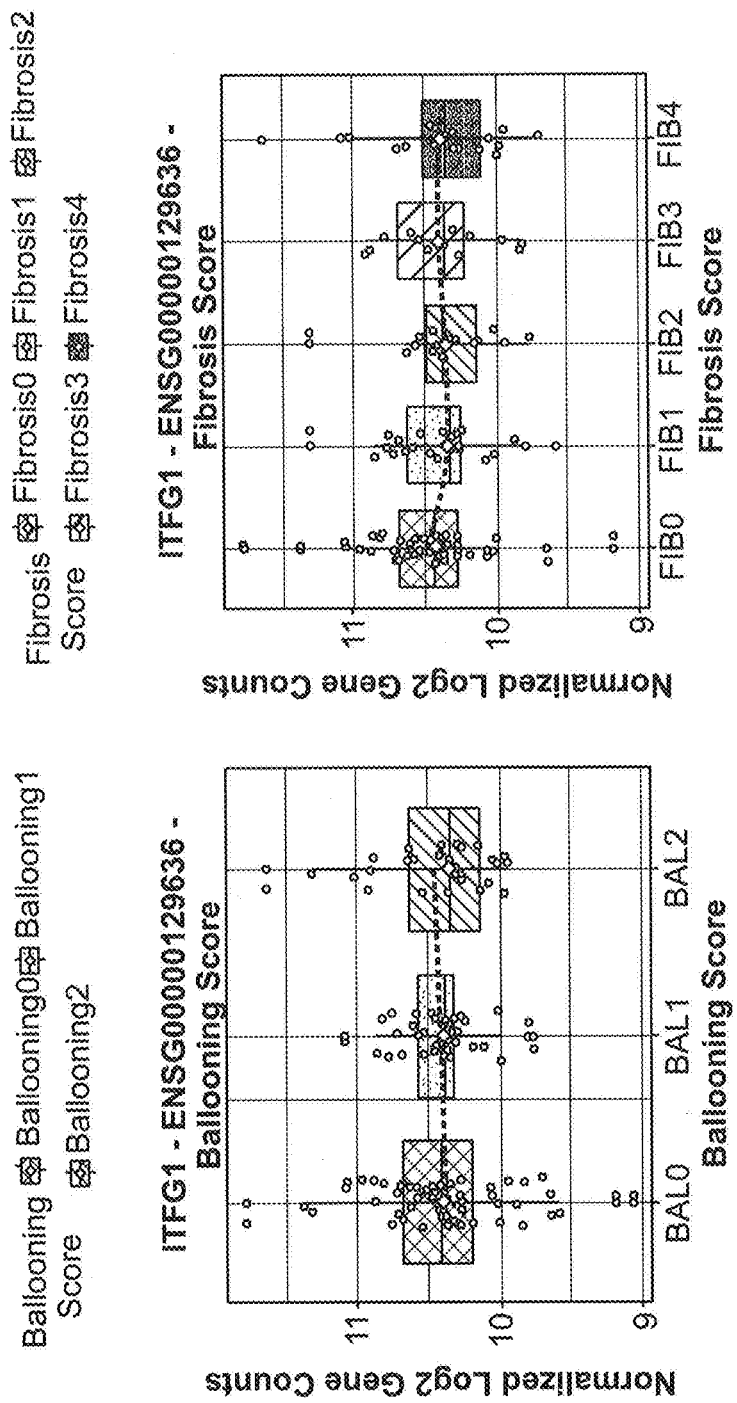
Figure 18E:
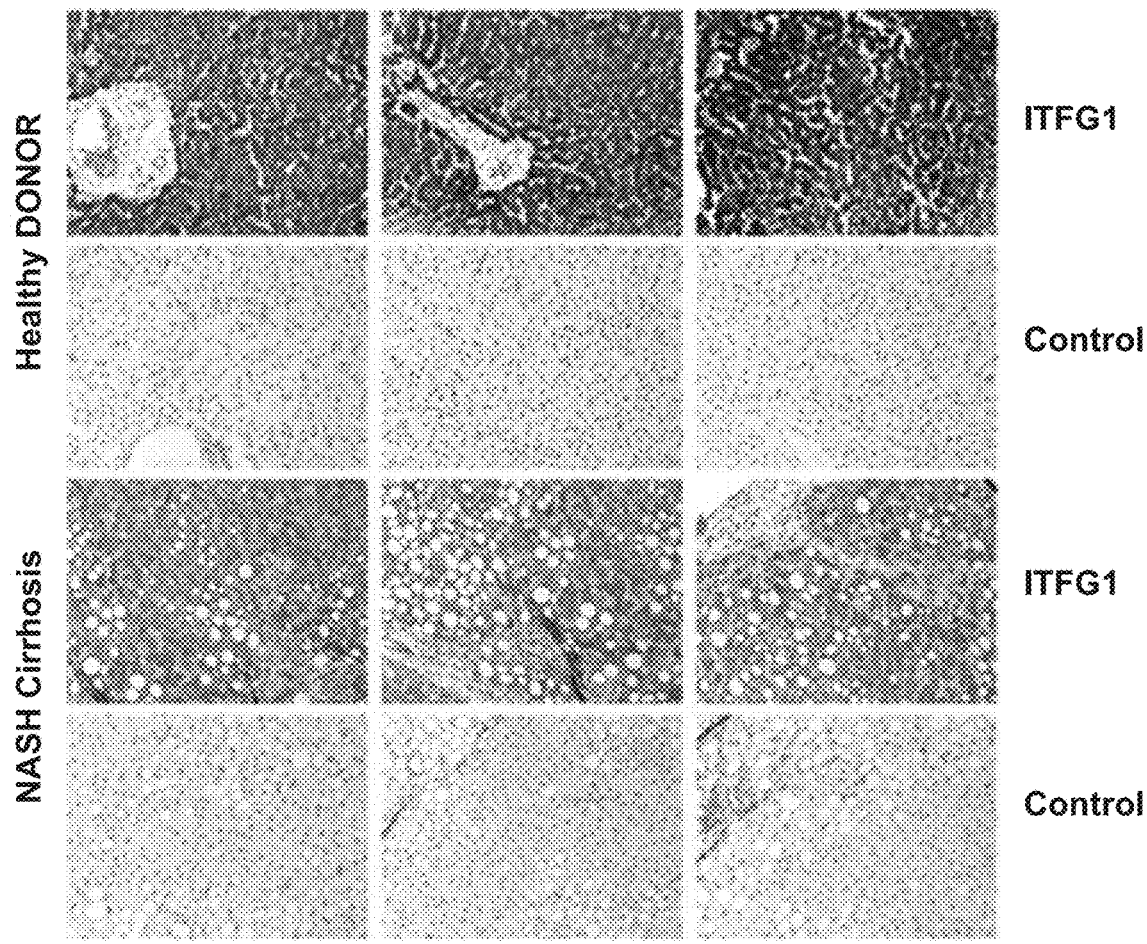
Figure 18F:
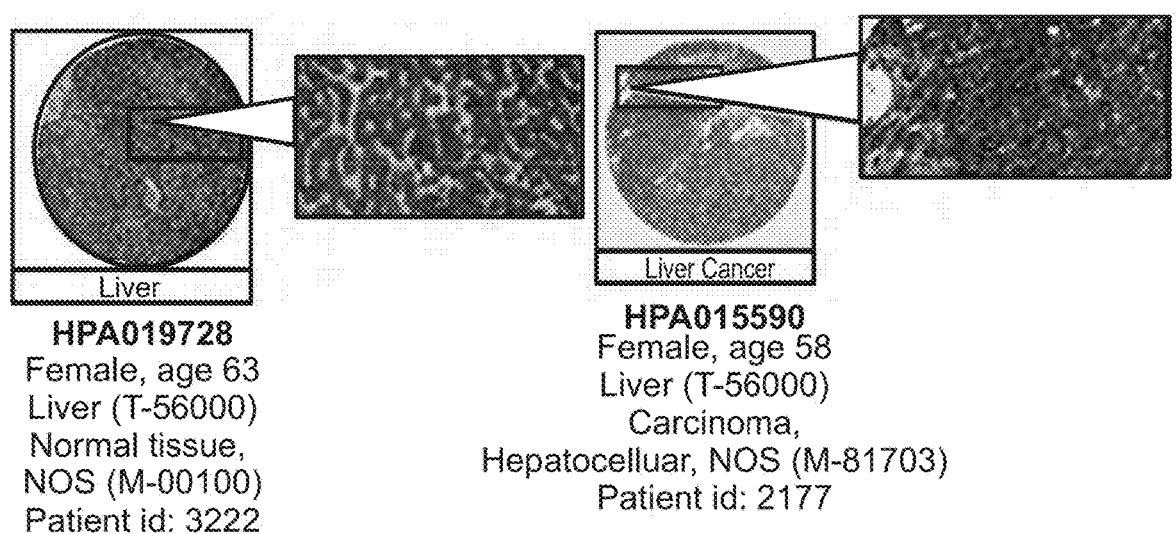
Figure 18G:
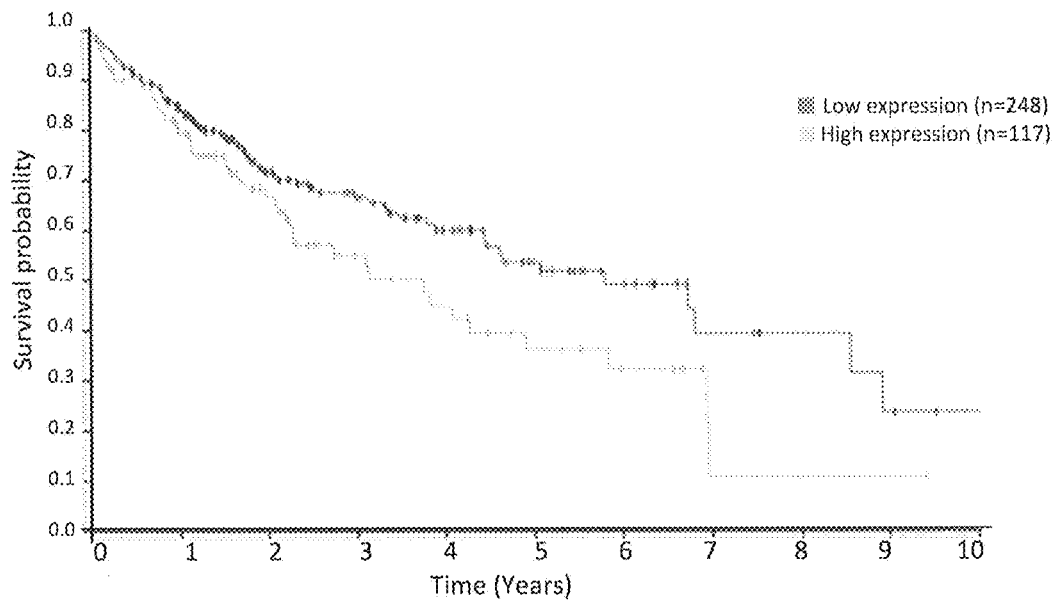
Figure 18H:
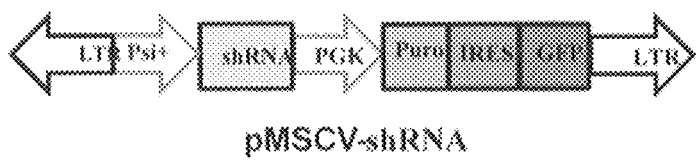
Figure 18I:
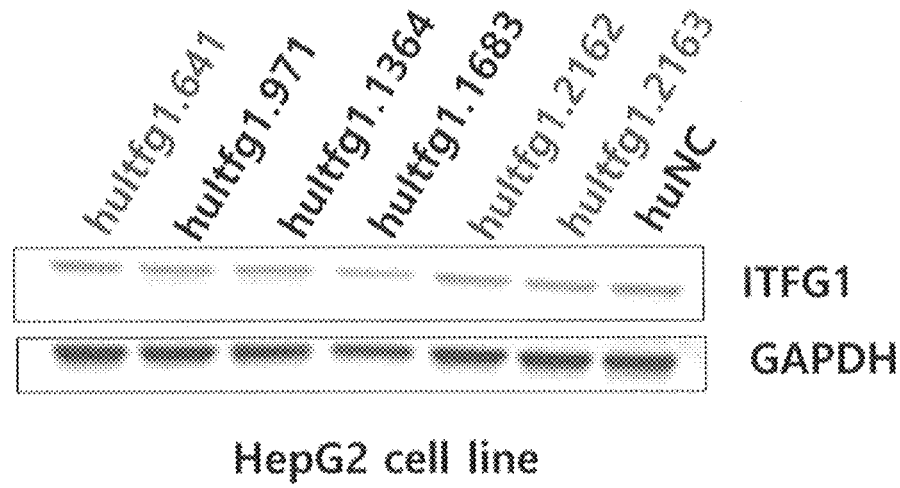
Figure 35A:
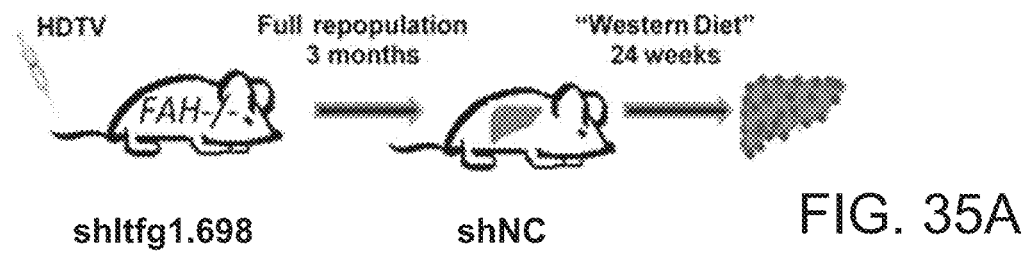
FIG. 35A, 35B, 35C, 35D, 35E, 35F: Itfg1 knockdown attenuates chronic liver damage related liver fibrosis in a NASH model FIG. 35A) Experimental outline. FAH−/− mice were injected with our constructs, then, mice were kept for full repopulation for 3 months. After full repopulation was reached mice were exposed to the "Western Diet" (high fat diet and 60% fructose) for 24 weeks. Livers were harvested, processed and analyzed.
Figure 35B:
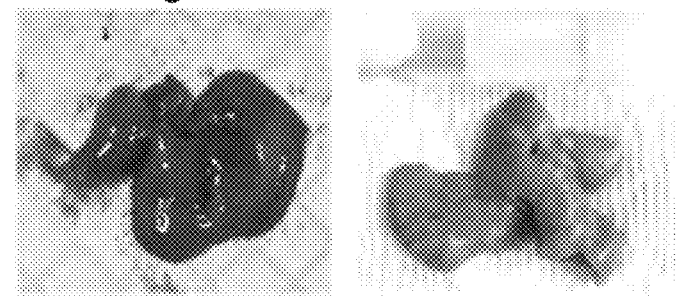
Figure 35C:
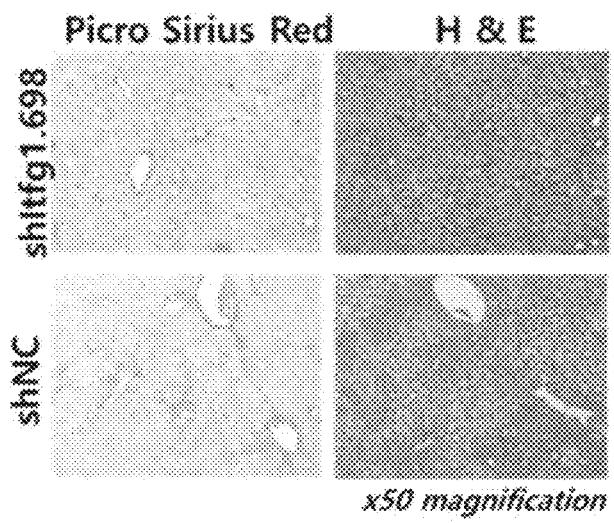
Figure 35E:
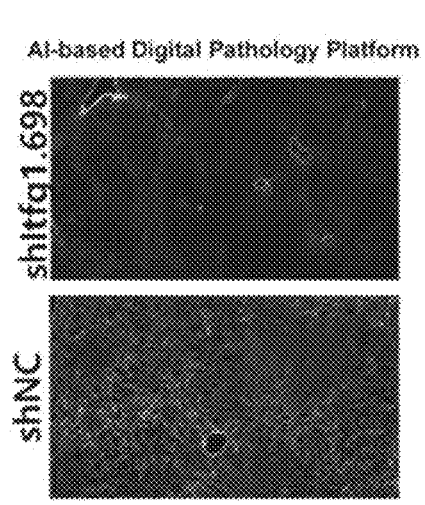
Figure 35D:
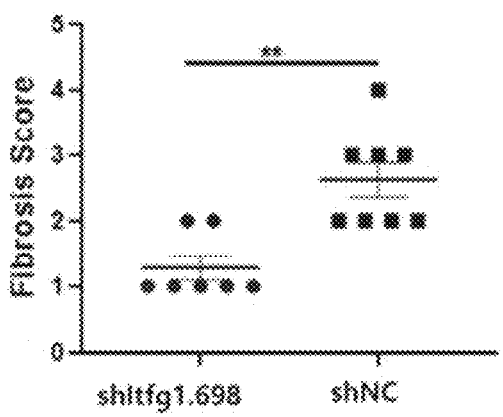
Figure 35F:
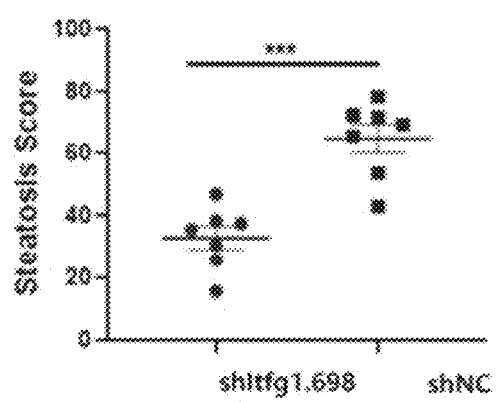

In the mouse Western Diet NAFLD model (FIG. 35A), knockdown of Itfg1 attenuates fibrosis development (FIG. 35B-35F), which could already be seen macroscopically (FIG. 18A). The rough surface on the liver of mice expressing a non-targeting control shRNA indicates advanced fibrosis. In contrast the surface of shItfg1 expressing livers indicates strong reduction in fibrosis. In addition objective analysis by HistoIndex with a proprietary AI pathology system, further showed significant reduction in steatosis by Itfg1 knockdown (FIG. 35E-35F). The expression data from our NAFLD patient cohort indicates no major expression changes in the liver during disease progression (FIG. 18B), suggesting a postranscriptional regulation. Itfg1 is expressed in healthy liver tissue and in NASH, Cirrhosis and hepatocellular carcinoma (FIG. 18C-18E). Data from The Human Protein Atlas show that low expression of Itfg1 is associated with increased survival in liver cancer patients (FIG. 18G). Interestingly, so far not much is known about Itfg1 and therefore it represents an interesting novel target for liver disease. Generating stable human HepG2 cell lines and determining the knockdown efficiency of different Itfg1 shRNAs showed a strong on-target knockdown (FIG. 18G-18H) for human Itfg1.

Figure 33A:
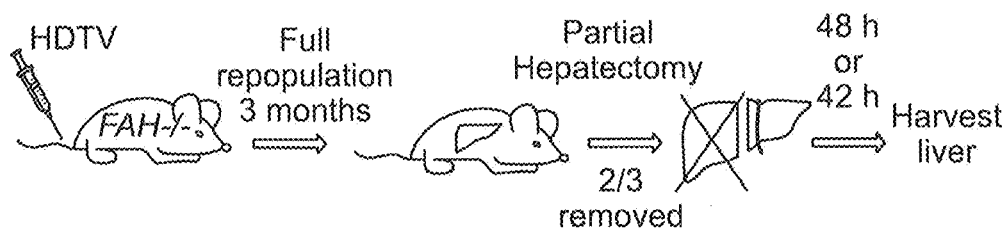
FIG. 33A, 33B, 33C: Itfg1 knockdown accelerates liver regeneration after partial hepatectomy (PH) FIG. 33A) Experimental outline. FAH−/− mice were injected with our constructs, then, mice were kept for full repopulation for 3 months. After that ⅔ of the liver was surgically removed. The remaining regenerating liver was harvested at 42 h and 48 h after surgery.
Figure 33B:
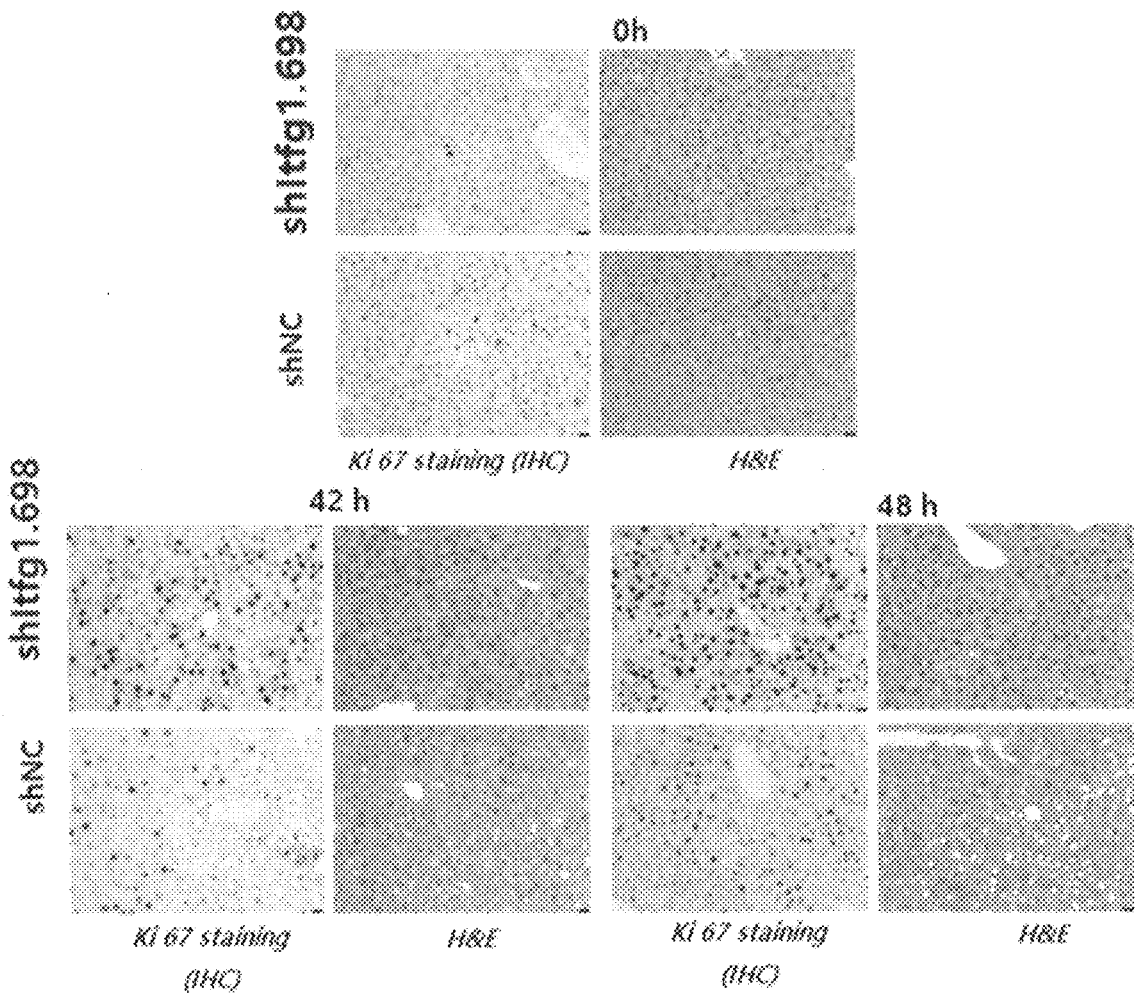
Figure 33C:
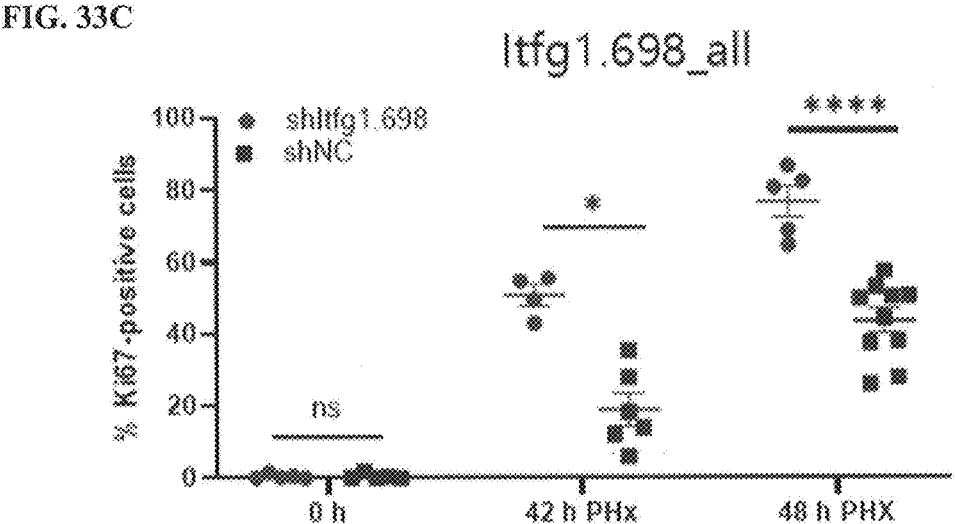
Figure 34D:
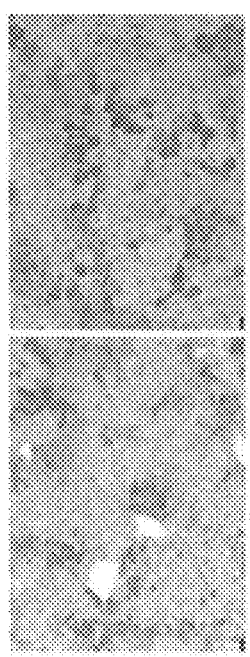
Figure 34E:
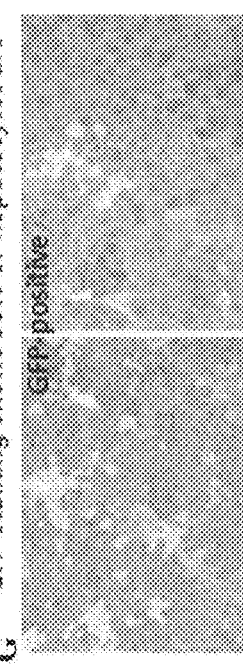
Figure 34F:
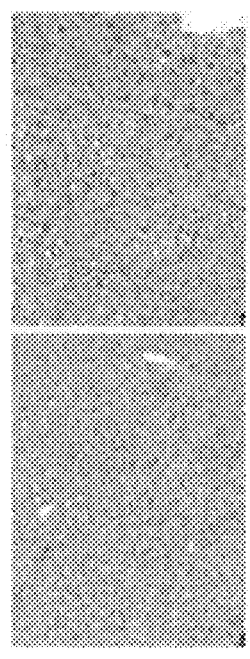
Figure 34G:
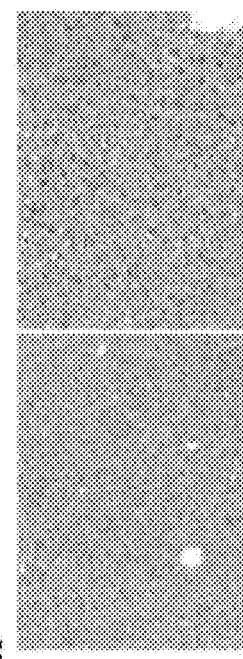

Again, taking advantage of the FAH−/− mice, the liver was completely repopulated for 3 months so that every hepatocyte expresses shItfg1 or a non-targeting control shRNA (shNC). Afterwards, ⅔ of the liver was removed and liver regeneration monitored (FIG. 33A). In the acute liver damaging model of ⅔ partial hepatectomy, Itfg1 knockdown accelerates regeneration after partial hepatectomy indicated by an earlier peak and higher amount of Ki67 positive cells (FIG. 33B-33C). No malignant disease and no GFP-positive tumor is observed 1 year after Itfg1 knockdown in mice (FIG. 34A-34E). Livers are fully repopulated in both the shItfg1 group and control group as indicated by around 95% GFP-positive hepatocytes.

Figure 36A:
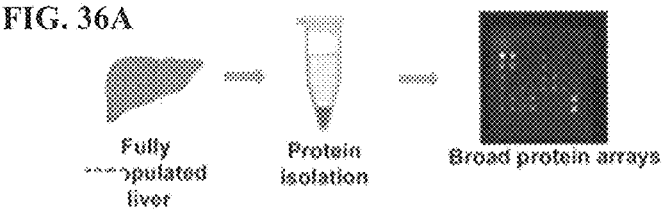
FIG. 36A, 36B, 36C: Knockdown of Itfg1 impacts MKK6, JNK, and RPS6 signaling FIG. 36A) Schematic outline of isolating proteins from full repopulated livers for further broad protein array analysis.
Figure 36B:
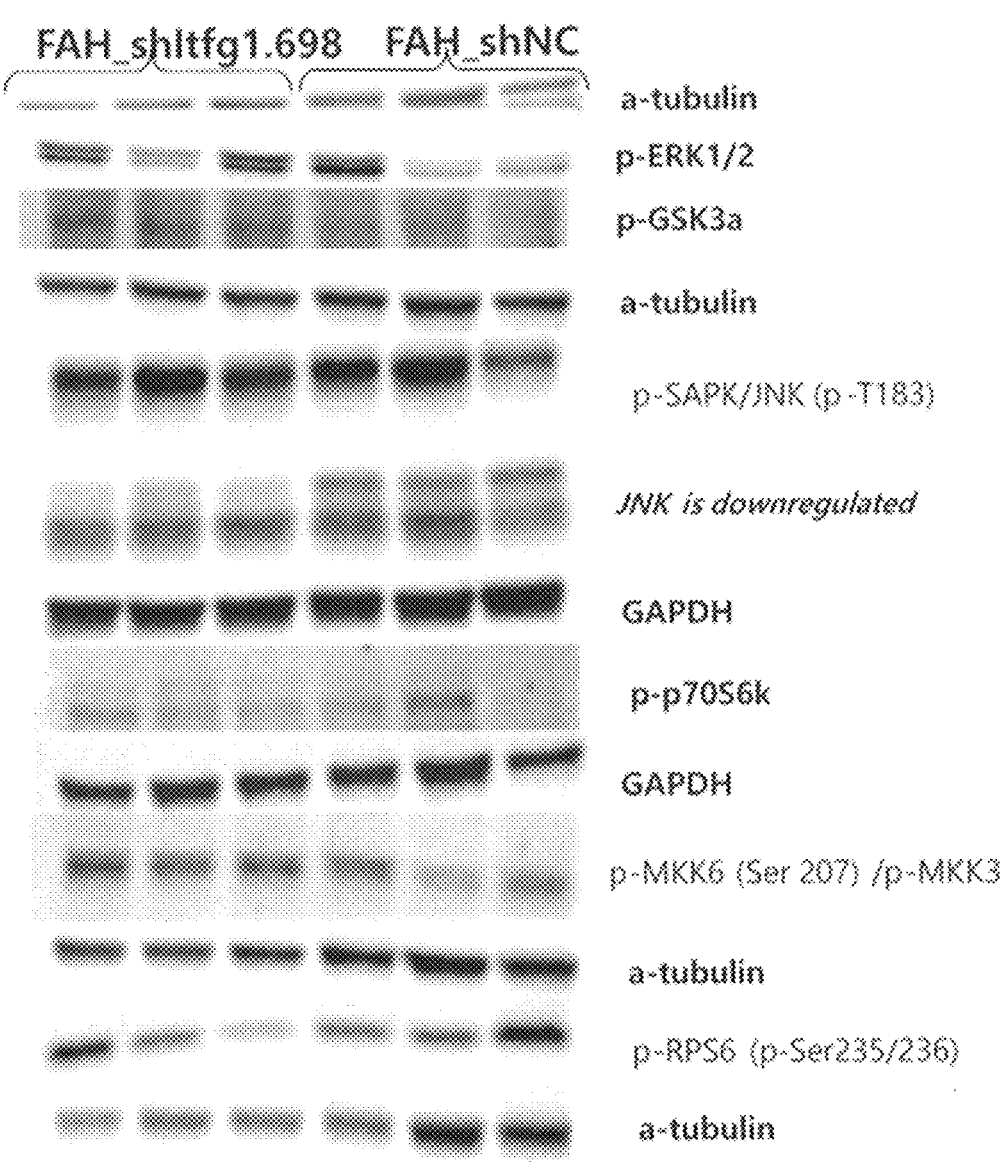
Figure 36C:
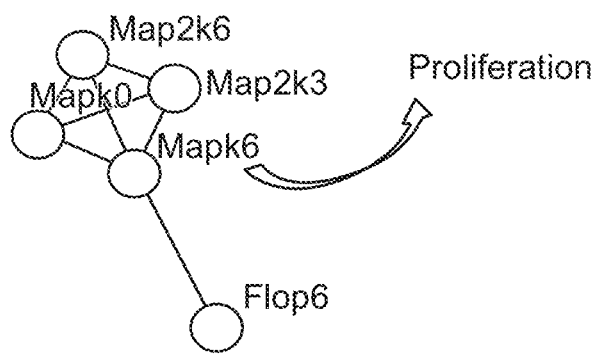

To investigate the differences in pathway activation after full repopulation with either shItfg1 or non-targeting control shRNA, proteins from full repopulated livers were isolated for further broad protein array analysis (FIG. 36A). After performing the broad protein array, focused Western blot experiments were carried out. It was observed that knockdown of ITFG1 impacts MKK6, JNK, and RPS6 signaling. In particular, P-MKK6/P-MKK3 are greater activated in case of Itfg1 knockdown compared to control (FIG. 36B). According to STRING database, all indicated proteins are interacting and are linked to cell growth and proliferation (FIG. 36C).

Figure 37A:
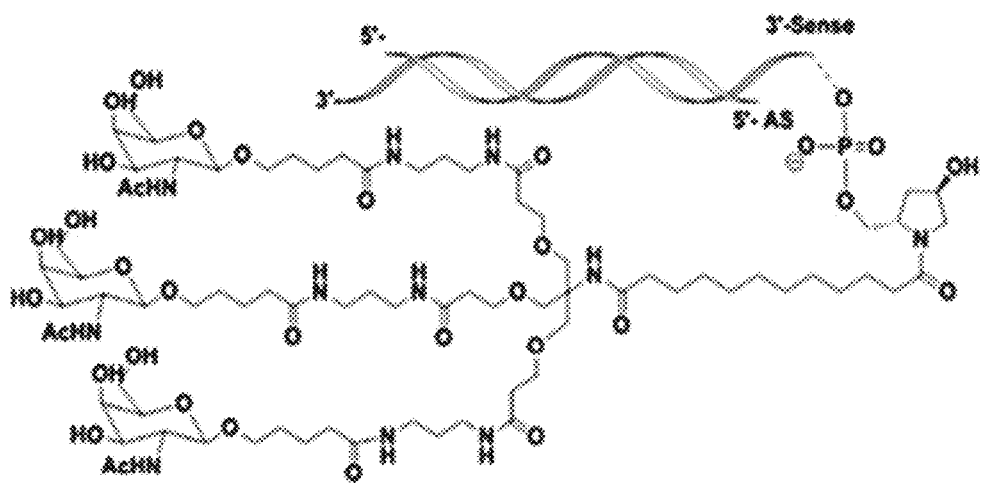
FIG. 37A, 37B: GalNAC conjugates with siRNA against Itfg1 (BNL CL.2 cell line; 72 h post-transfection) FIG. 37A) Structure of GalNAC-siRNA conjugate used in studies. Exact backbone modifications can be found in the sequence appendix (SEQ ID NOs: 7095 and 7096). The target sequence for the siRNA was based on the shRNA guide sequence.
Figure 37B:
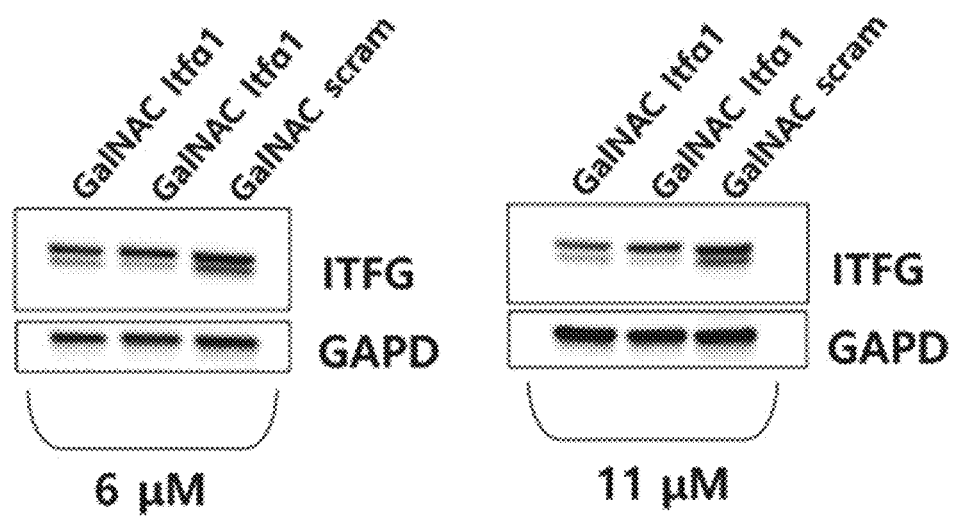

Modified siRNA-GalNAC conjugates were generated to target Itfg1 (FIG. 37A, Table 11; SEQ ID NOs: 7095 and 7096). Western blot analysis with 6 μM and 11 μM, respectively, shows efficient knockdown of Itfg1 by two different conjugates GalNAC-si Itfg1.698 and GalNAC-si Itfg1.680 compared to control (FIG. 37B).

Mfap4 or Itfg1 Knockdown in Mouse Lung Cell Line and Mouse Myoblast Cell Line

Figure 38A:
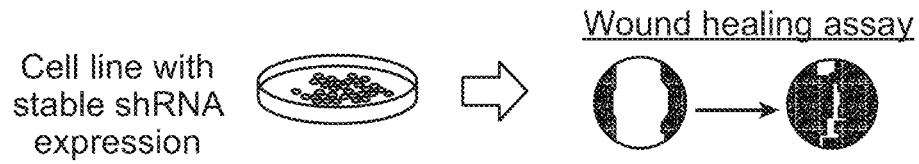
FIG. 38A, 38B, 38C: Mfap4 and Itfg1 knockdown enhances proliferation and regeneration beyond liver FIG. 38A) Outline of the wound healing assay. Stable cell lines were generated expressing the respective shRNAs.
Figure 38B:
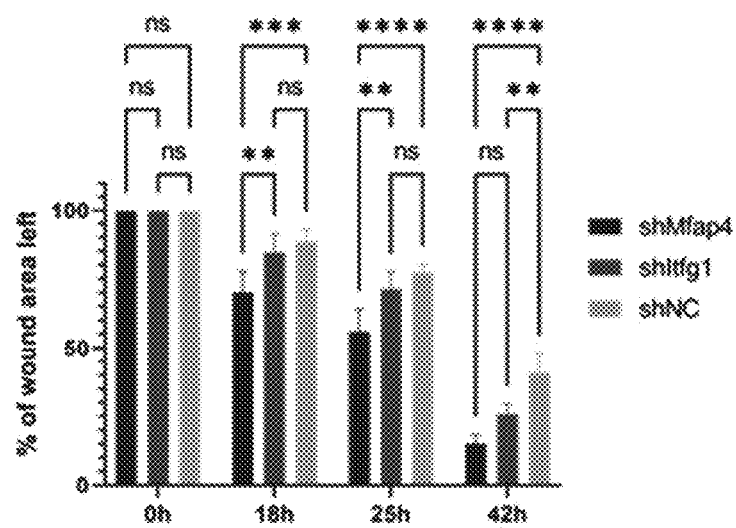
Figure 38C:
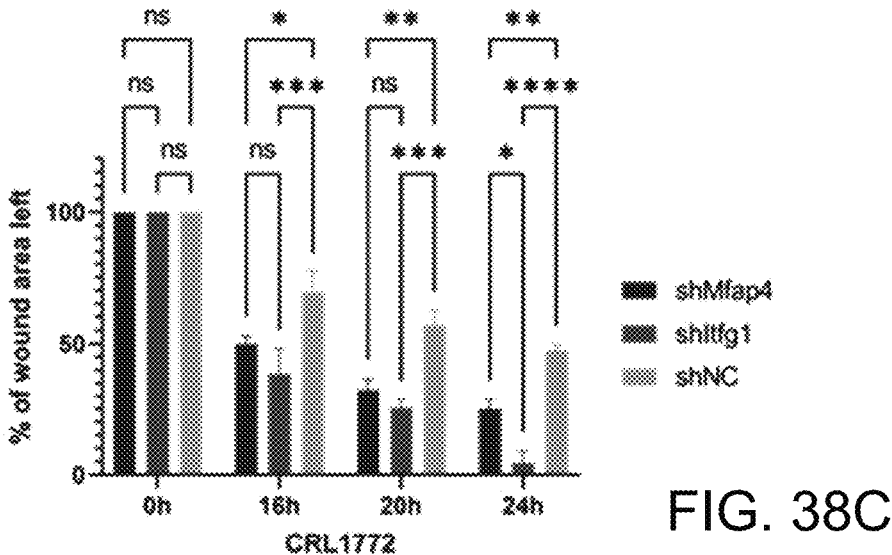

Stable cell lines using mouse lung cell line CCL206 and mouse myoblast cell line CRL1722 were generated expressing the respective shRNA—shMfap4, shItfg1 or control shNC (FIG. 38A). Knockdown of Mfap4 as well as the knockdown of Itfg1 accelerates wound healing of mouse lung cells as well as of mouse myoblast cells. These results suggest that Mfap4 and Itfg1 knockdown enhances proliferation and regeneration not only of liver but also of lung and myoblasts.

Example 3—EMULSION +500 Screen and Target Validation

Figure 19A:
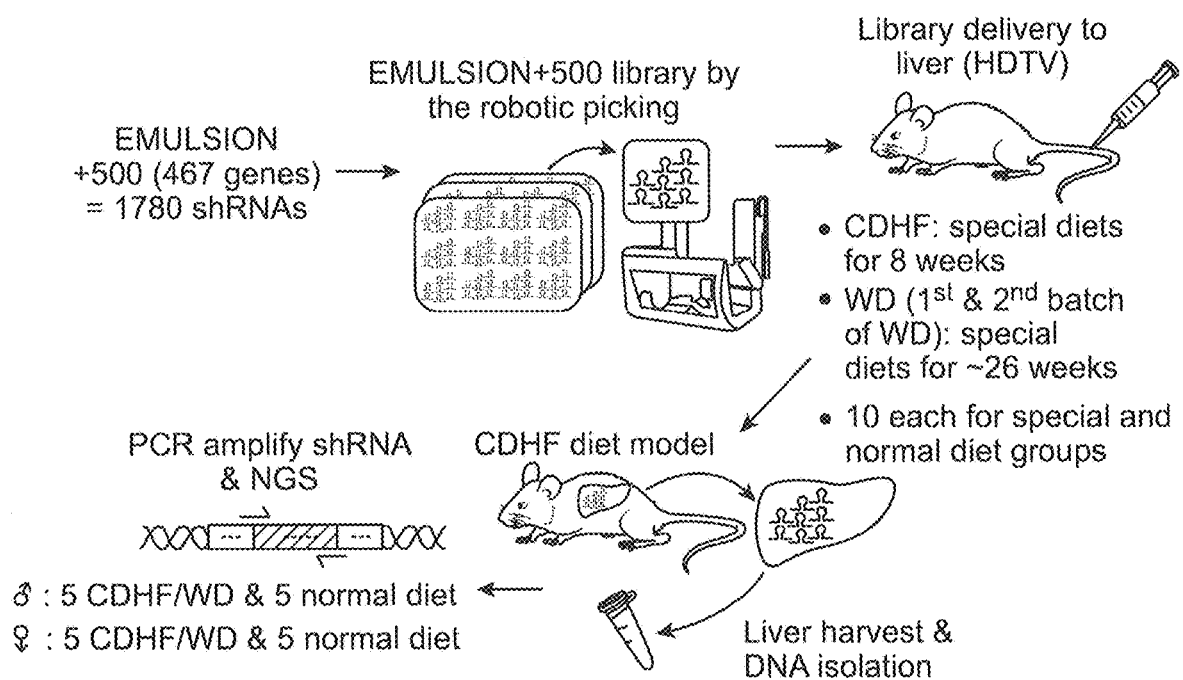
FIG. 19A, 19B, 19C, 19D: EMULSION +500 in vivo functional genetic screen FIG. 19A) Schematic outline of the screen. A pooled shRNA library screen targeting 467 genes, dysregulated in human NAFLD patients, is set up. The screen is conducted in mice of both gender using two diet based NAFLD models.

Independent of the TAA chronic damage-induced screen, a functional genetic screen using a focused shRNA library containing 1780 shRNAs targeting 467 genes was also conducted. These 467 genes are the mouse homologs corresponding to differentially up-regulated genes found in our NAFLD patient cohort (FIG. 19A). The screen was conducted in two diet-based mouse models of NAFLD, the "Western Diet" (WD) model (FIG. 4A-4H) and the Choline deficient L-amino acid defined high fat diet (CDHFD) model (FIGS. 20A and 20B). The CDHFD is a very aggressive and fast model leading to NASH with advanced fibrosis in 8 weeks. In contrast, the WD takes about half a year to reach this stage. Similar to the TAA screen, the shRNA library was delivered to the liver by hydro-dynamic tail vine injection (HDTV). The combination of transposon-based constructs with a sleeping beauty 13 transposase-expressing plasmid leads to the stable integration in about 5 to 10% of hepatocytes. After injection, the respective diet exposure was started until NASH with late fibrosis is reached. After harvesting the liver the genomic DNA is isolated, part of the shRNA expression cassette is amplified and the abundance sequenced by NGS. Enriched shRNAs are identified, which indicates an advantage by these shRNAs in the context of fatty liver disease.

Figure 19B:
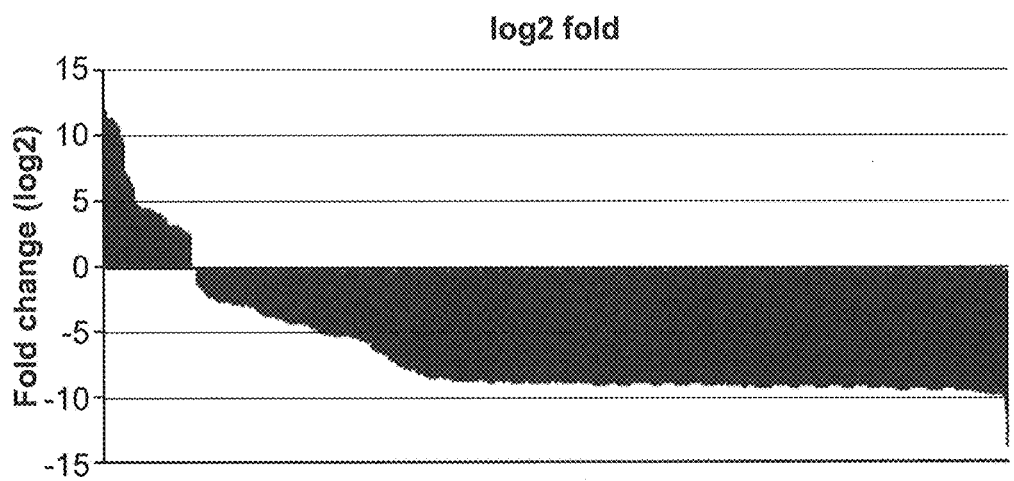
Figure 19C:
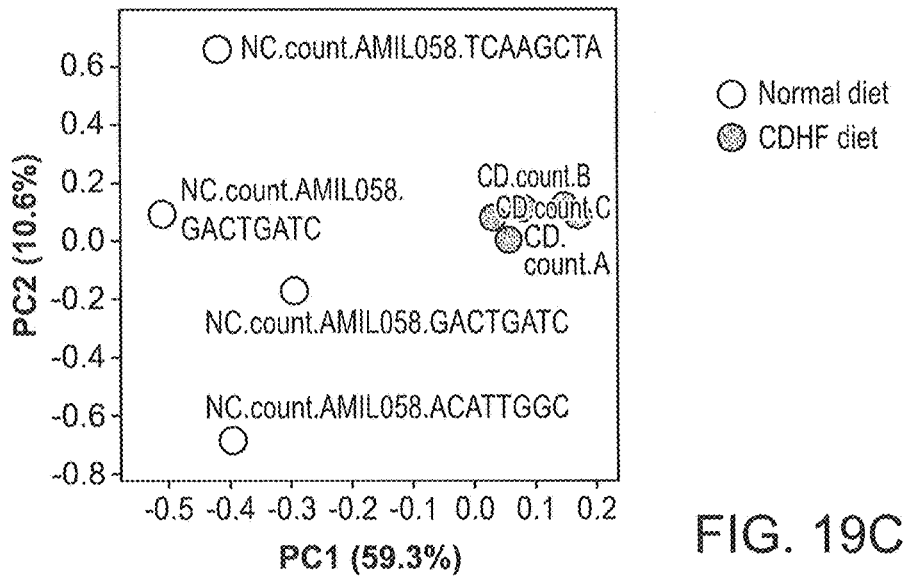
Figure 19D:
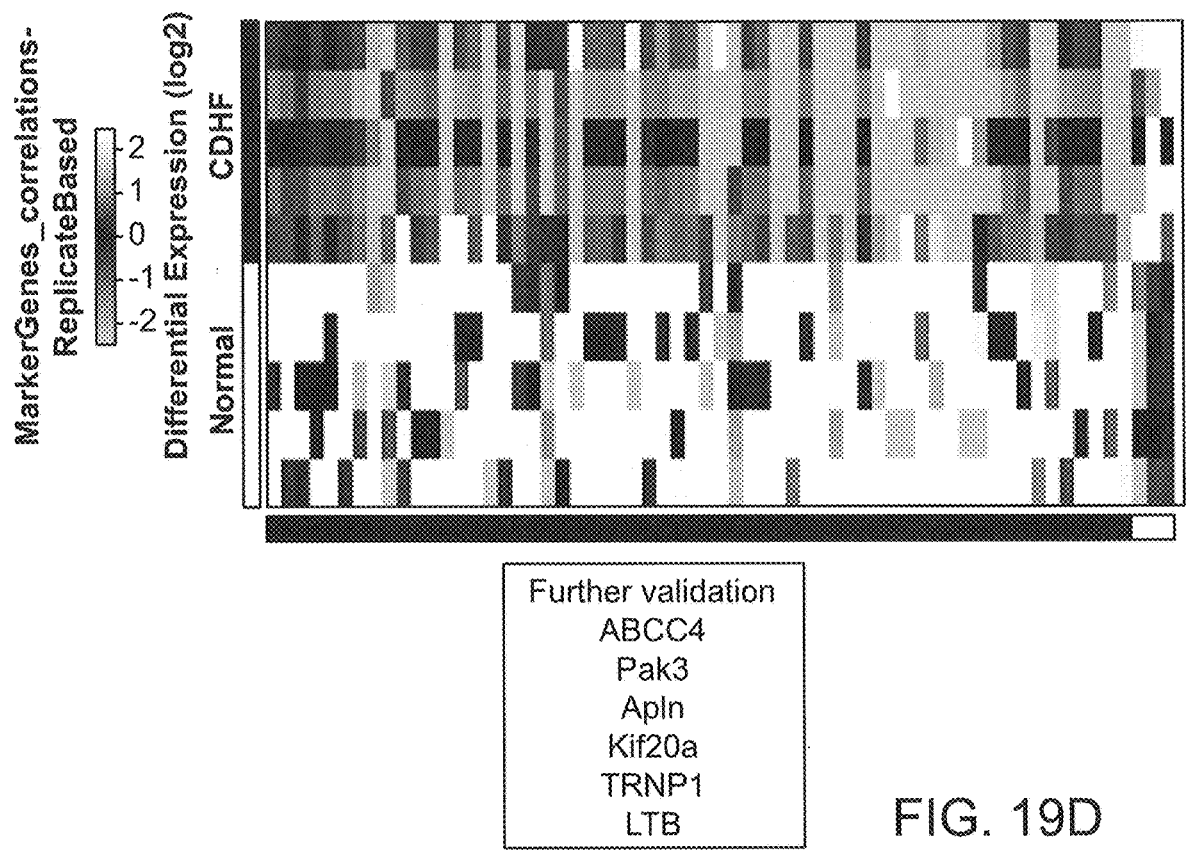

In the CDHFD model the majority of shRNAs were depleted (FIG. 19B). Interestingly, based on normalized shRNA abundance level in a principal component analysis, clear segregation between our CDHFD vs normal chow exposed mice (FIG. 19C) was seen. In-depth differential abundance shRNA analysis was then performed. Six shRNAs/targets for validation (FIG. 19D) were identified based on reliable enrichment in the majority of animals. Importantly, as the library was designed based on relevant human patient data and this is a functional genetic screen, scoring in the screen can already be seen as the first validation step.

ABCC4—ATP Binding Cassette Subfamily C Member 4 (MRP4)

Figures 21A, 21B:
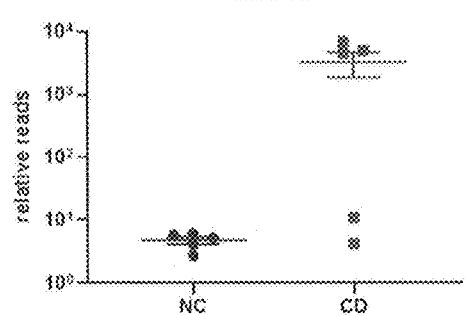
FIG. 21A, 21B, 21C, 21D, 21E: Abcc4 is a potential therapeutic target for NAFLD FIG. 21A) Shown is the relative read numbers for the shRNA expression cassette targeting Abcc4 for each animal (NC=normal chow, CD=CDHFD).
Figure 21C:
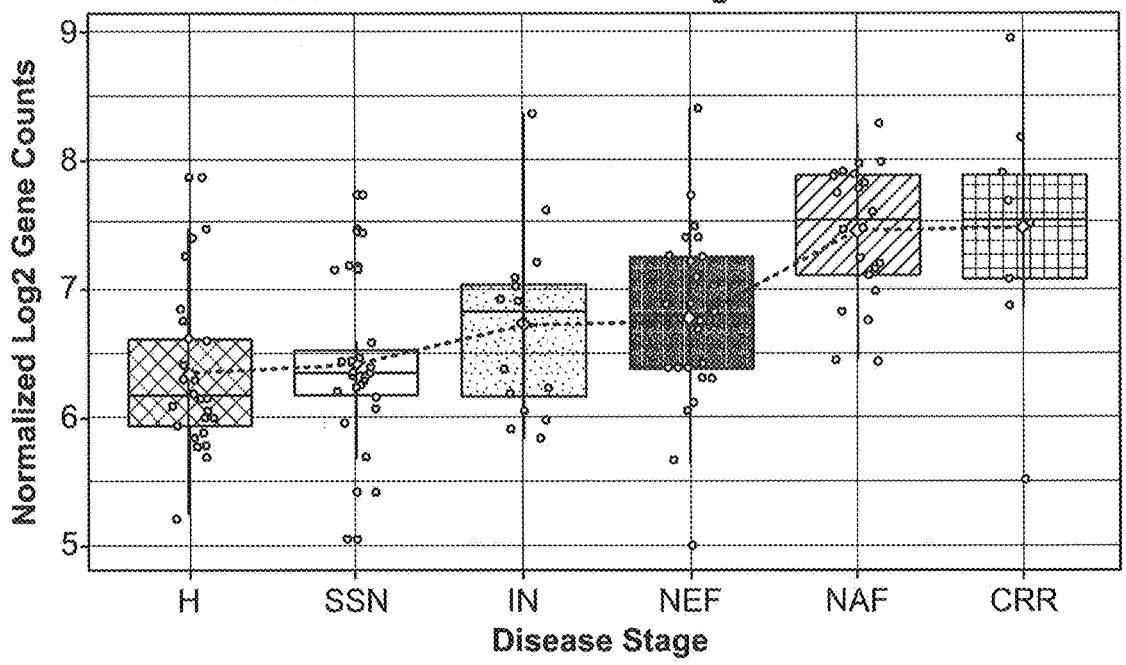
Figure 21D:
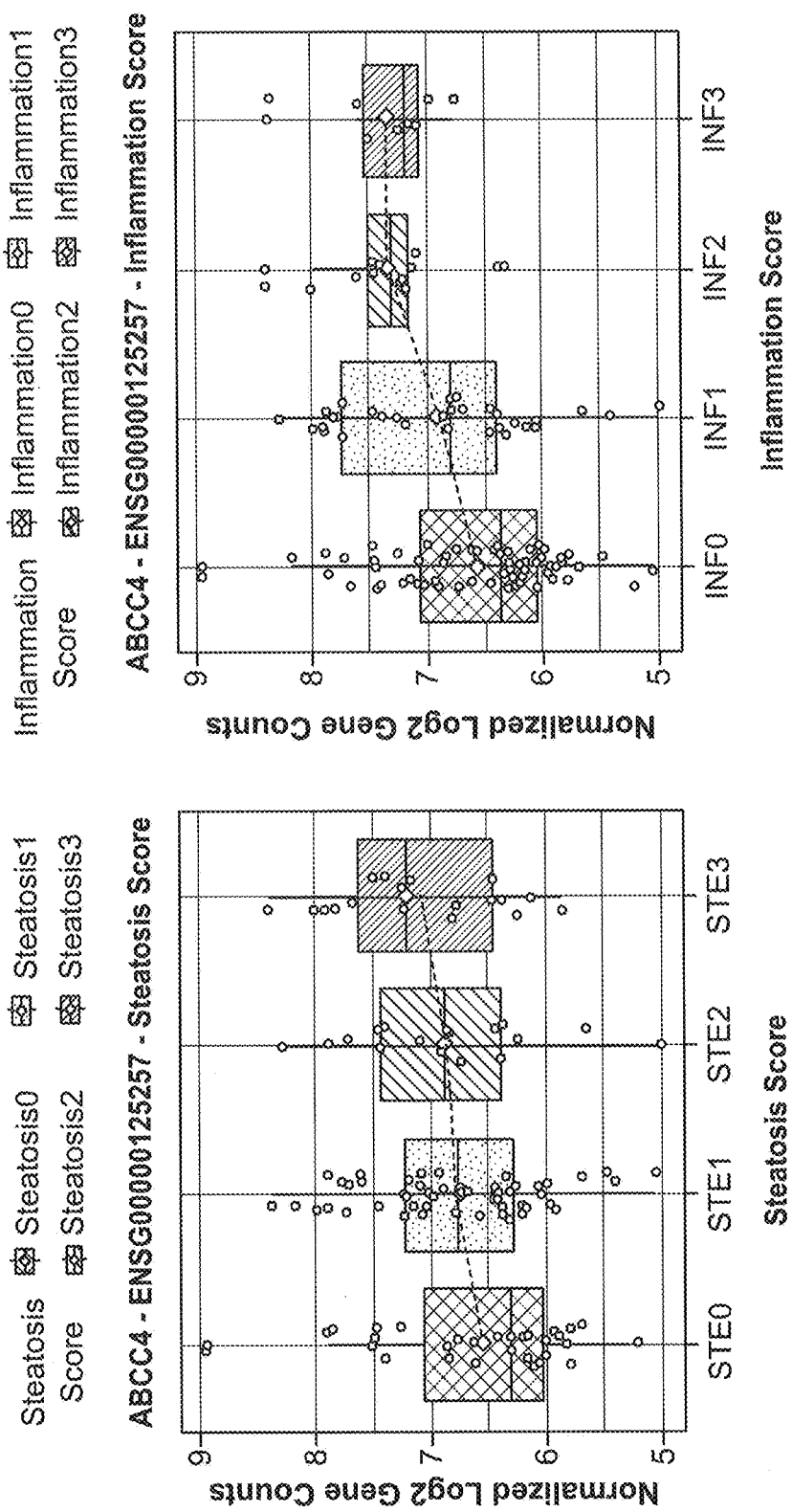
Figure 21E:
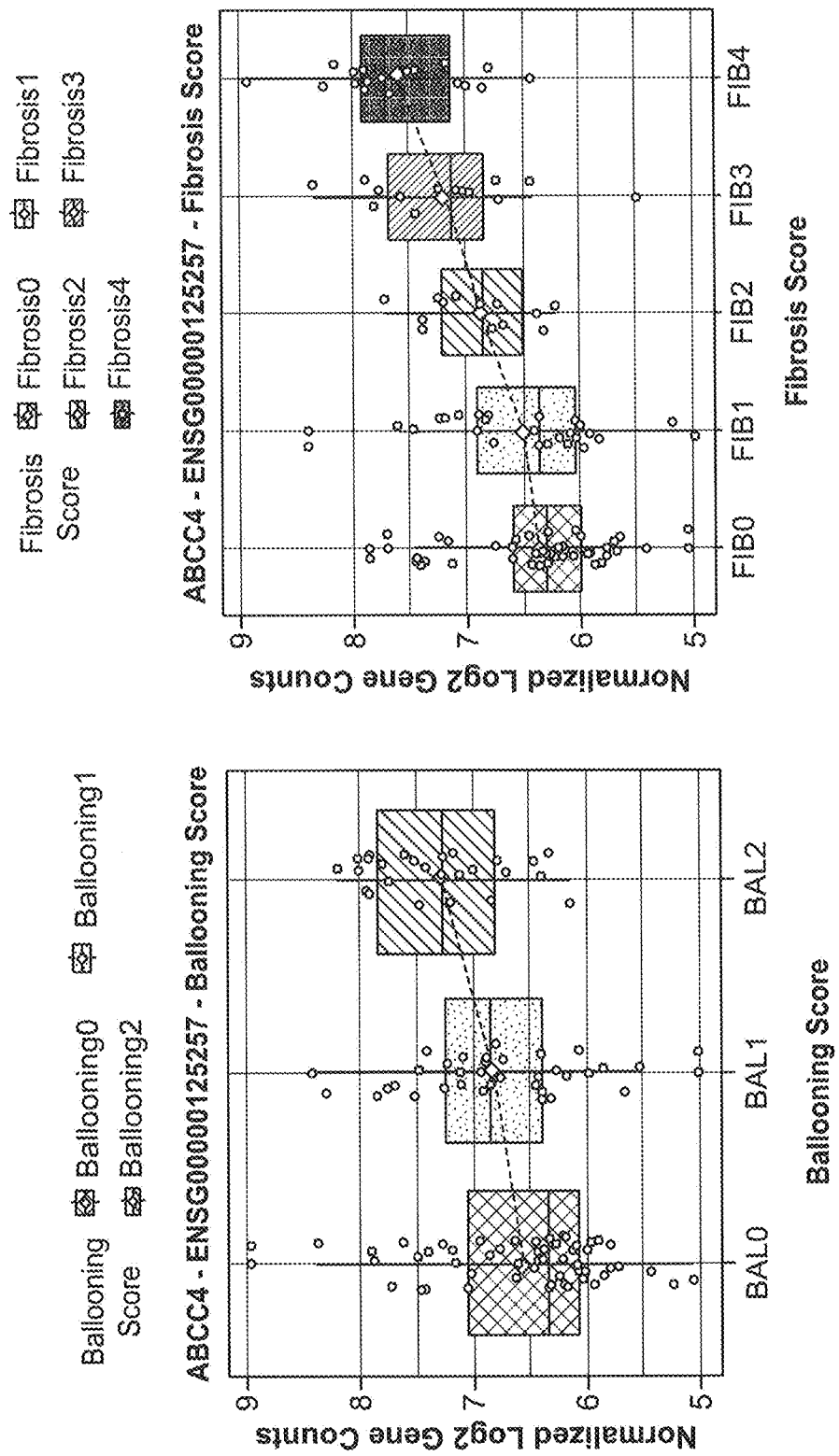

This target is a transporter that mediates the efflux of bile components into the blood. Interestingly in all control diet exposed mice, only a low number of relative reads was detected, whereas a strong enrichment in 3 out of 5 CDHFD mice was seen (FIG. 21A-21B). Furthermore, the expression of this gene increases during disease progression in the human patient cohort (FIG. 21C-21E). The expression also significantly increases in relation to the inflammation, fibrosis and ballooning score.

PAK3—P21 (RAC1) Activated Kinase 3

Figure 22A:
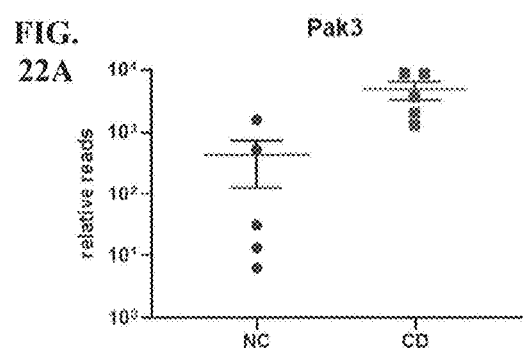
Figure 22B:
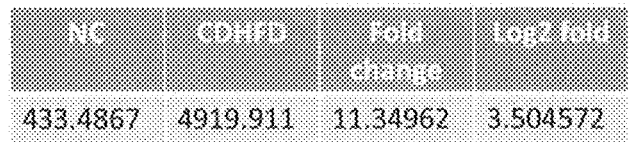
Figure 22D:
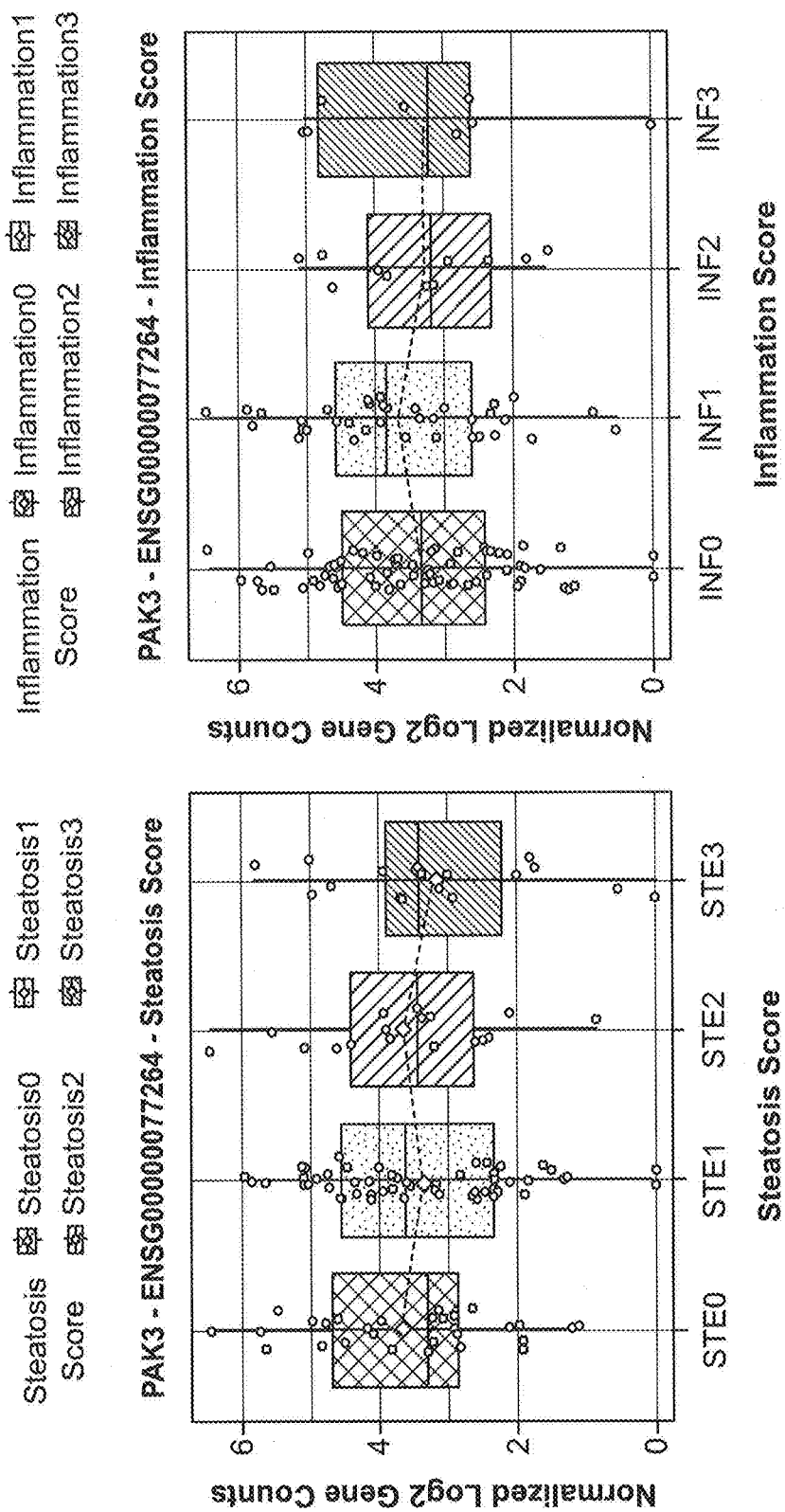
Figure 22E:
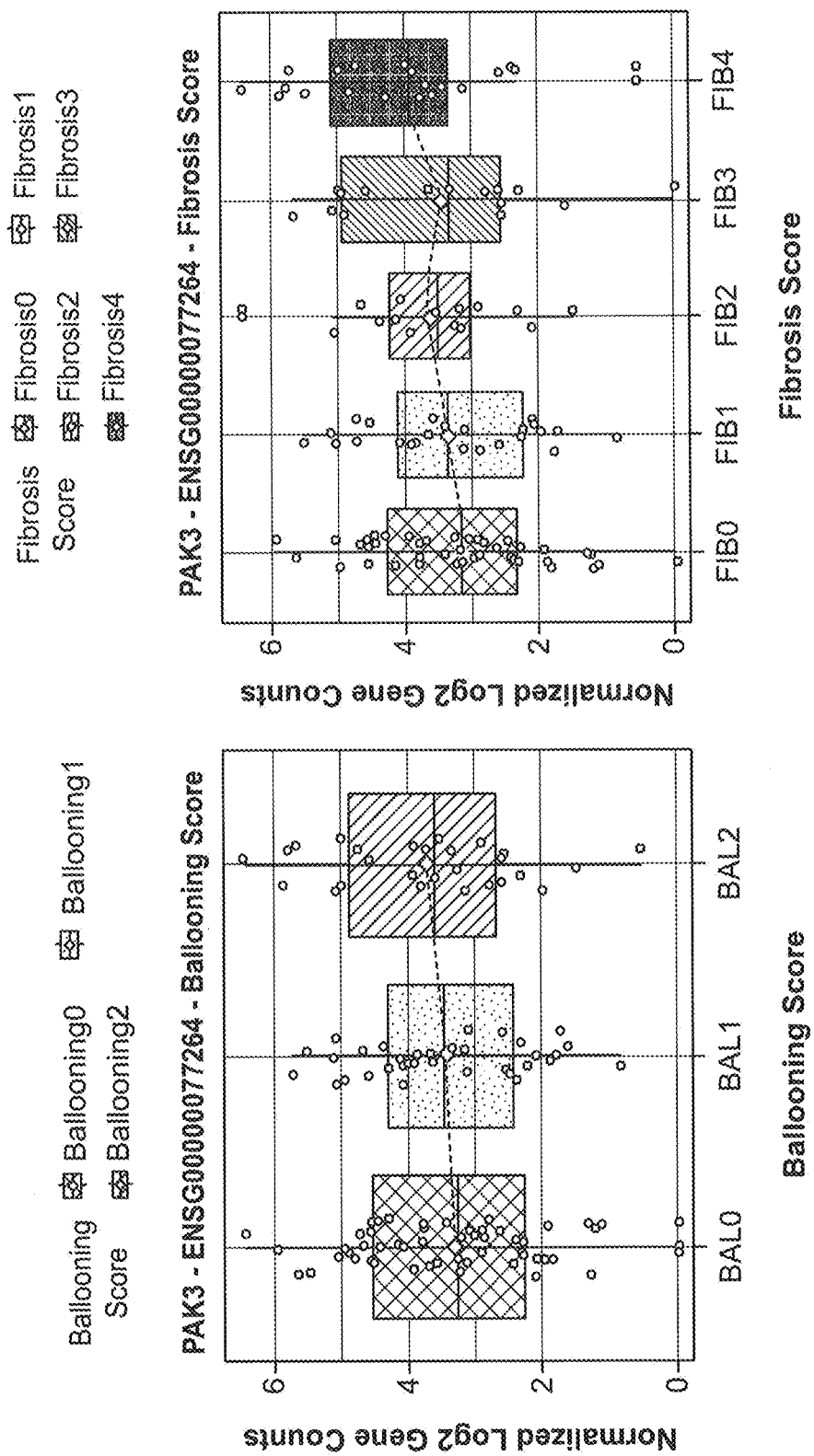
Figure 39:
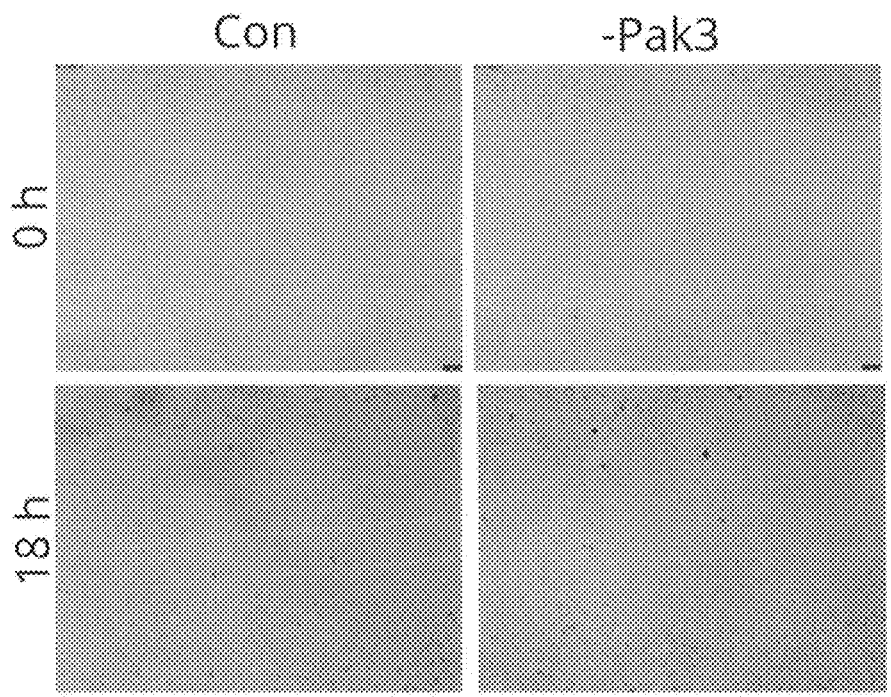
FIG. 39: Pak3 knockdown accelerates wound healing in vitro Stable knockdown of Pak3 in AML12 adult hepatocyte cell line accelerates wound healing (representative images are shown).

This target is a serine-threonine kinase. In 4 out of 5 mice enrichment for the shRNA targeting PAK3 (FIG. 22A-B; SEQ ID NO: 9) was seen. The expression of PAK3 is significantly upregulated in cirrhosis and fibrosis score 4 NAFLD patients (FIG. 22C-22E). As liver and pancreas both derive from the foregut endoderm during development, it is interesting that Pak 3 was described as a regulator of beta-cell differentiation. In that context, Pak3 promotes cell cycle exit and therefore would have an anti-proliferative function. Therefore, this is a highly interesting target for liver disease and regeneration, too, as confirmed by stable knockdown of Pak3 in the AML12 adult hepatocyte cell line, which accelerates wound healing (FIG. 39).

TRNP1—TMF1 Regulated Nuclear Protein 1

Figure 23A:
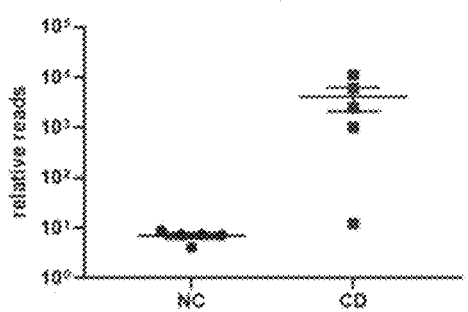
Figure 23B:
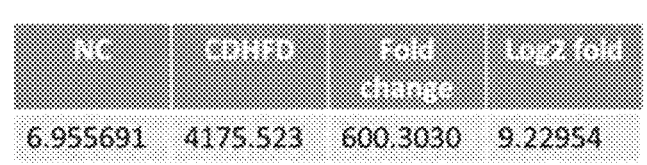
Figure 23D:
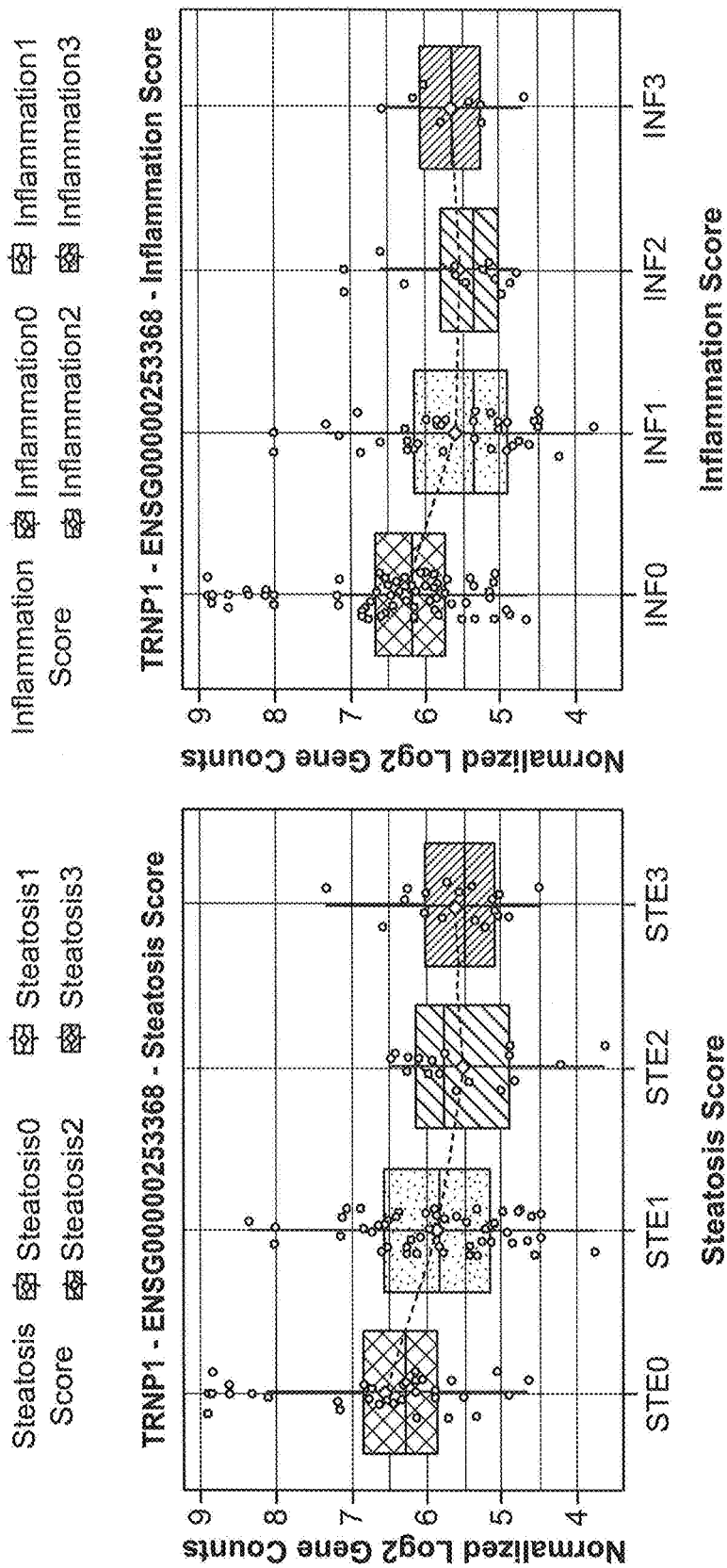
Figure 23E:
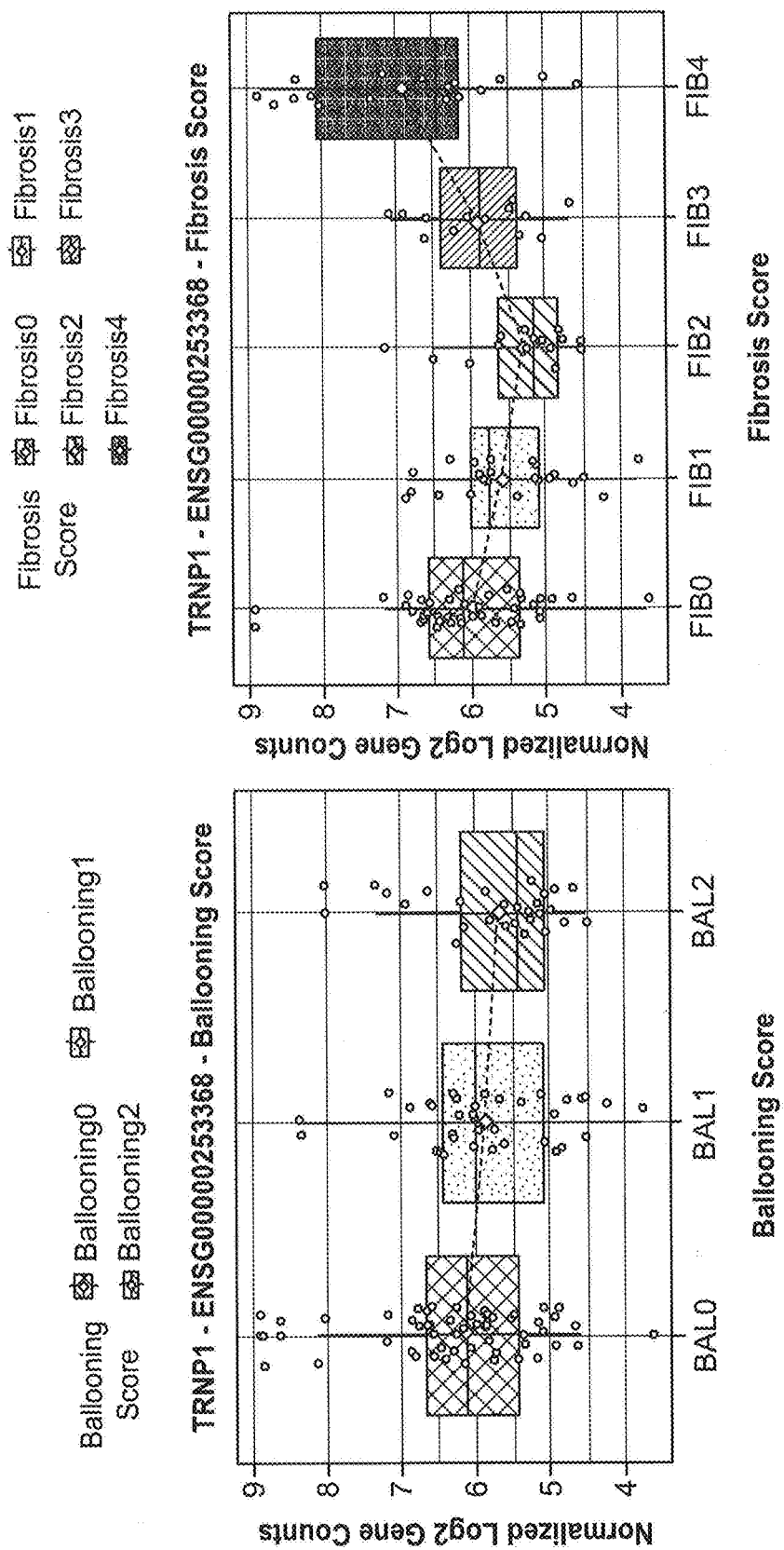

This target is a DNA-binding factor with a crucial role in brain development and accelerates cell-cycle progression. So far, no liver related function is described. In control fed mice, a consistent selection against shTrnp1 expressing cells (low relative reads) was detected. However, 4 out of 5 mice on CDHFD show enrichment for shTrnp1 (FIG. 23A-23B; SEQ ID NO: 13). Our human NAFLD patient cohort shows a complicated gene expression pattern of Trnp1 in the liver. In the earlier disease stages, we see a downregulation, but upregulation at the cirrhosis stage (FIG. 23C-23E). Consistent with this during steatosis we see a progressive downregulation.

APLN—Apelin

Figures 24A, 24B:
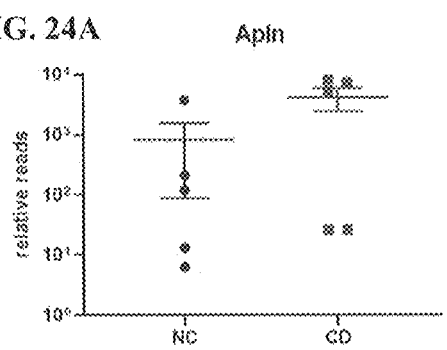
Figure 24D:
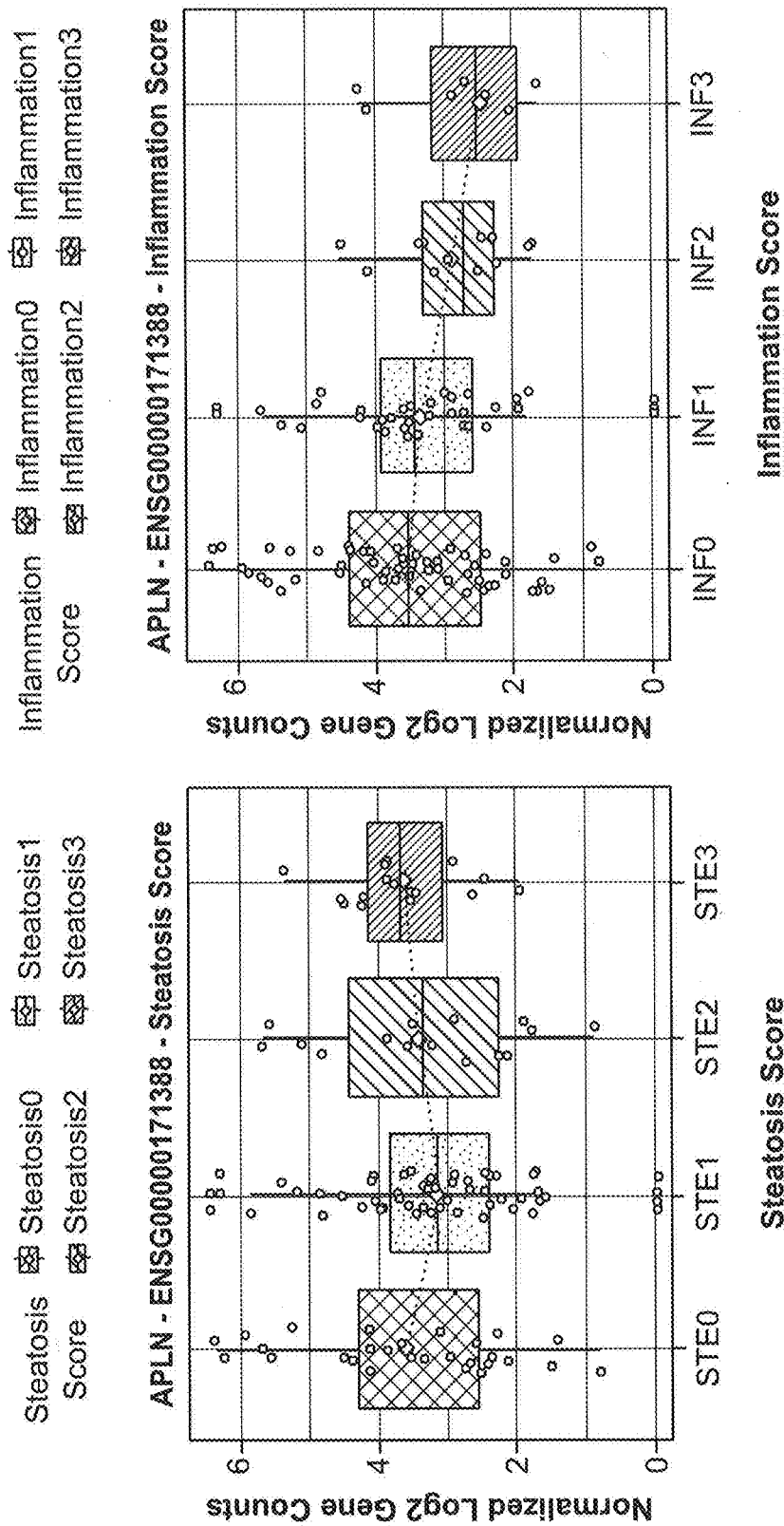
Figure 24E:
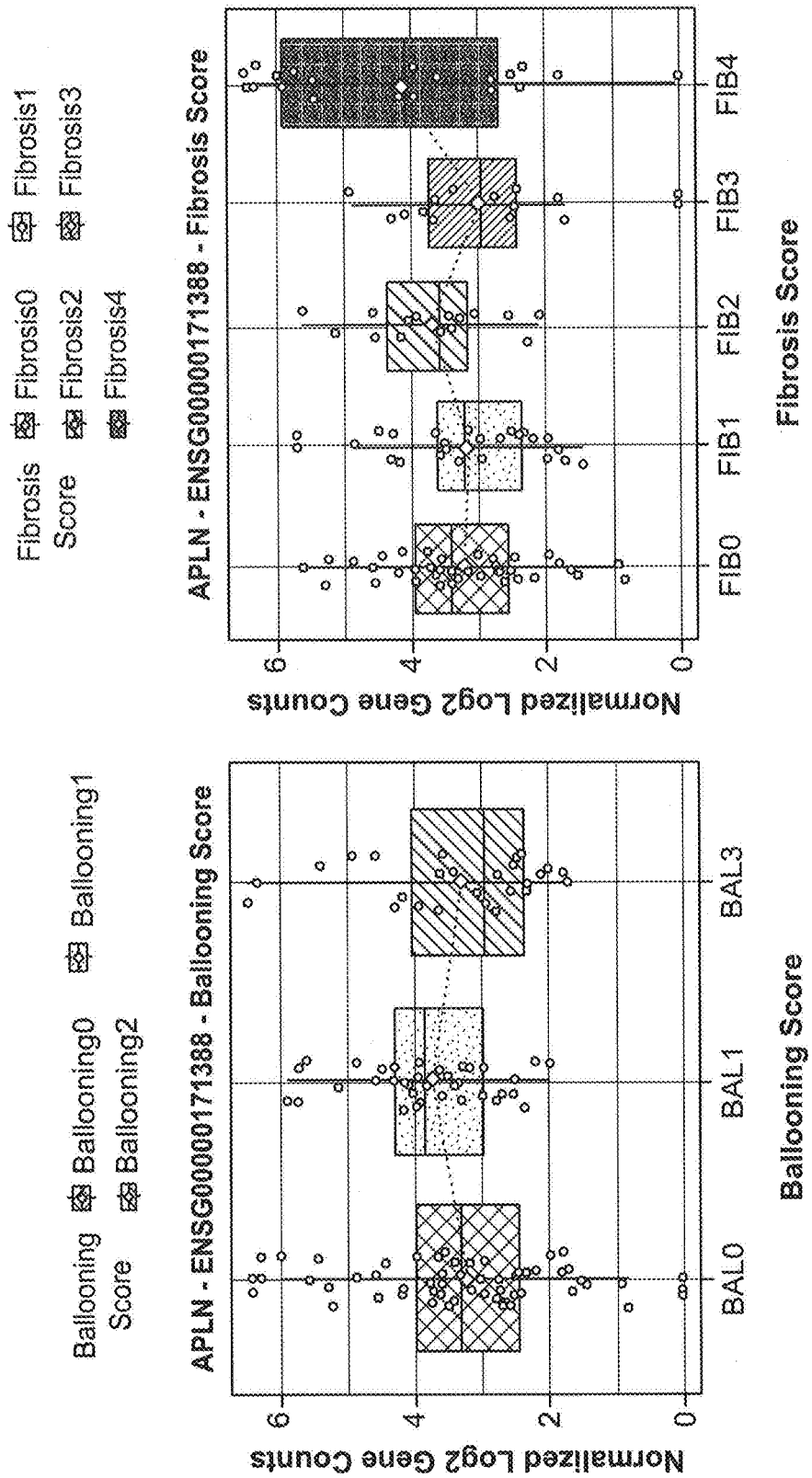

This target encodes a peptide that functions as an endogenous ligand for the G-protein coupled apelin receptor. In 3 out of 5 CDHFD mice, a strong enrichment for the shRNA targeting Apln compared to the control (FIG. 24A-24B; SEQ ID NO: 11) was seen. Based on the NAFLD patient cohort a significant upregulation at the cirrhosis stage is seen and consistent with this at a fibrotic score of 4 (FIG. 24C-24E). There is already a publication suggesting that Apln promotes hepatic fibrosis through ERK signaling. Also, Apln was described to be different in NAFLD patients and fatty liver rats and suggested as a diagnostic marker. Importantly, the encoded protein is processed into active peptide fragments, making it difficult to be targeted by classic drug approaches and ideal for RNAi based therapeutics.

KIF20A—Kinesin Family Member 20A

Figure 25A:
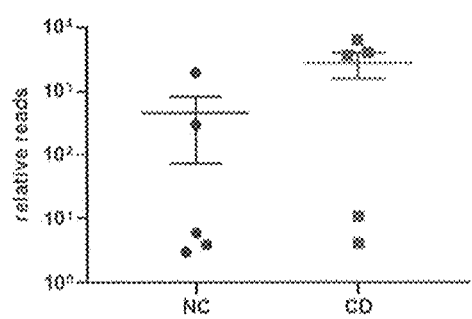
FIG. 25A, 25B, 25C, 25D, 25E: Kif20a is a potential therapeutic target for NAFLD FIG. 25A) Shown is the relative read numbers for the shRNA expression cassette targeting Kif20a for each animal (NC=normal chow, CD=CDHFD).
Figure 25B:
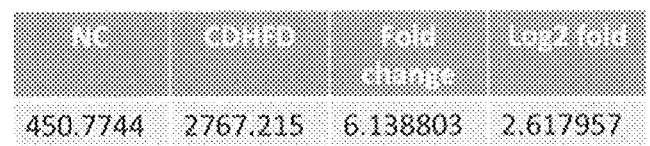
Figure 25C:
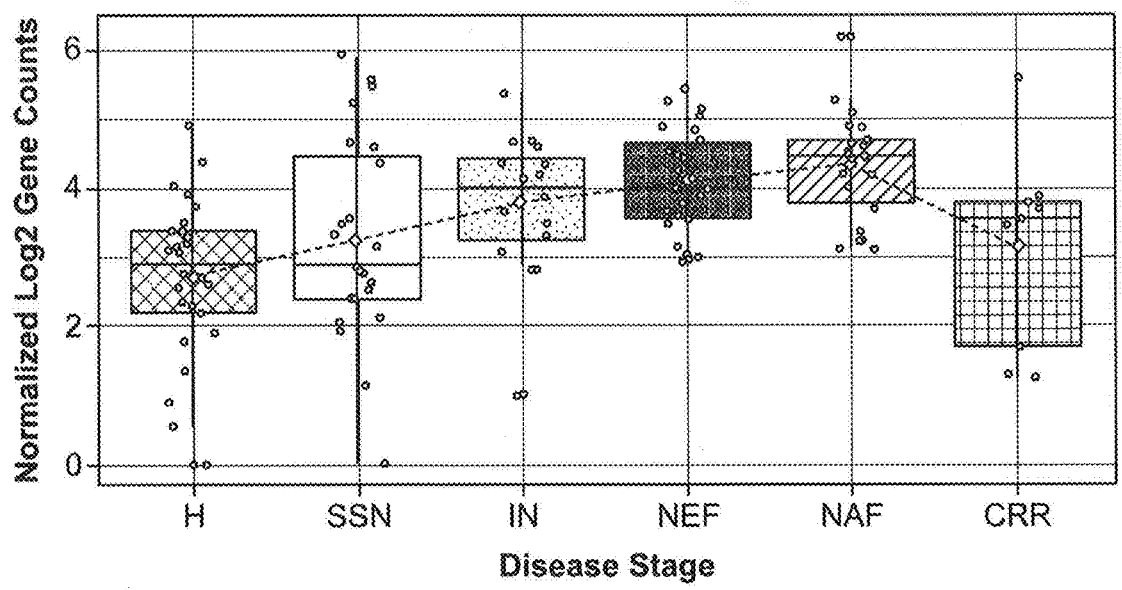
Figure 25D:
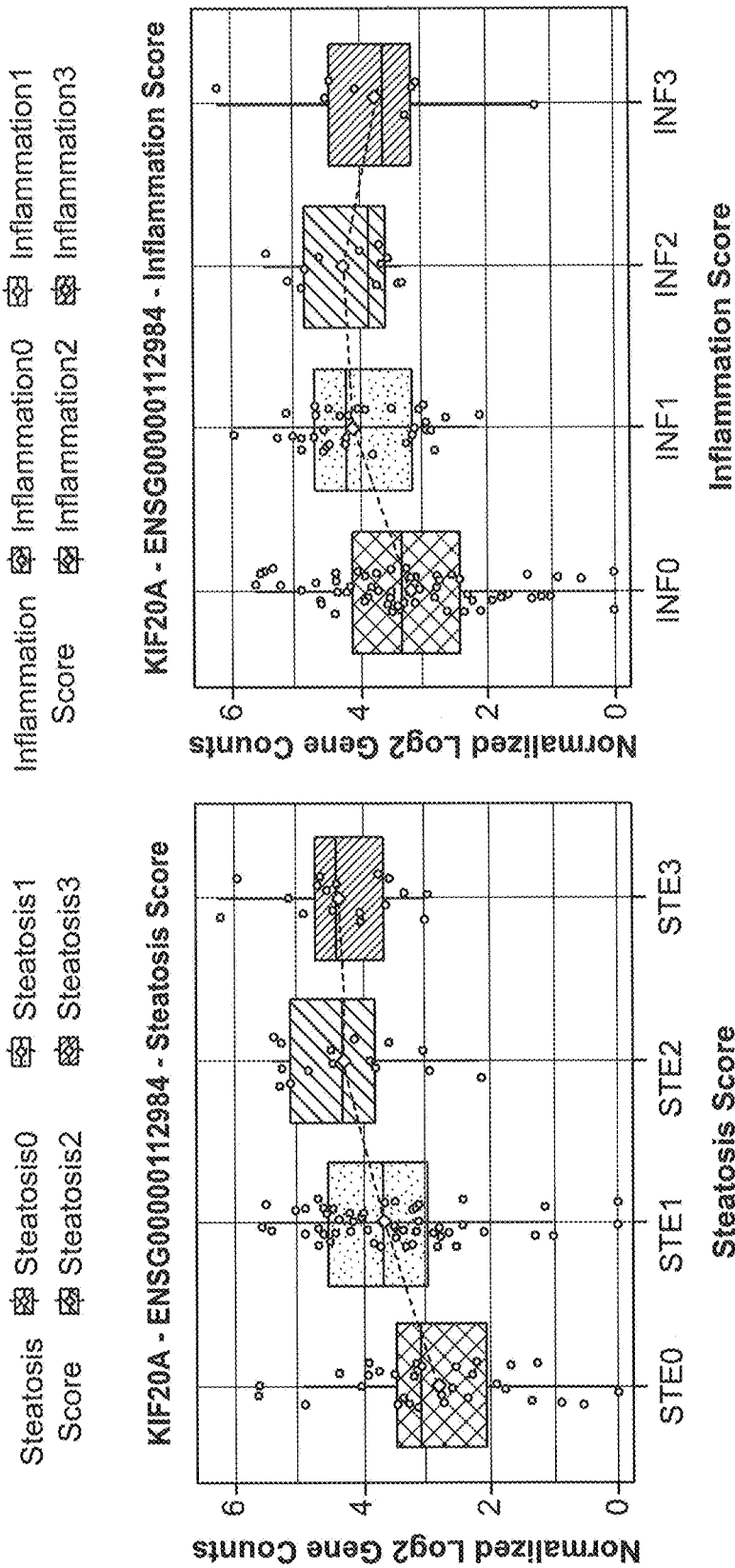
Figure 25E:
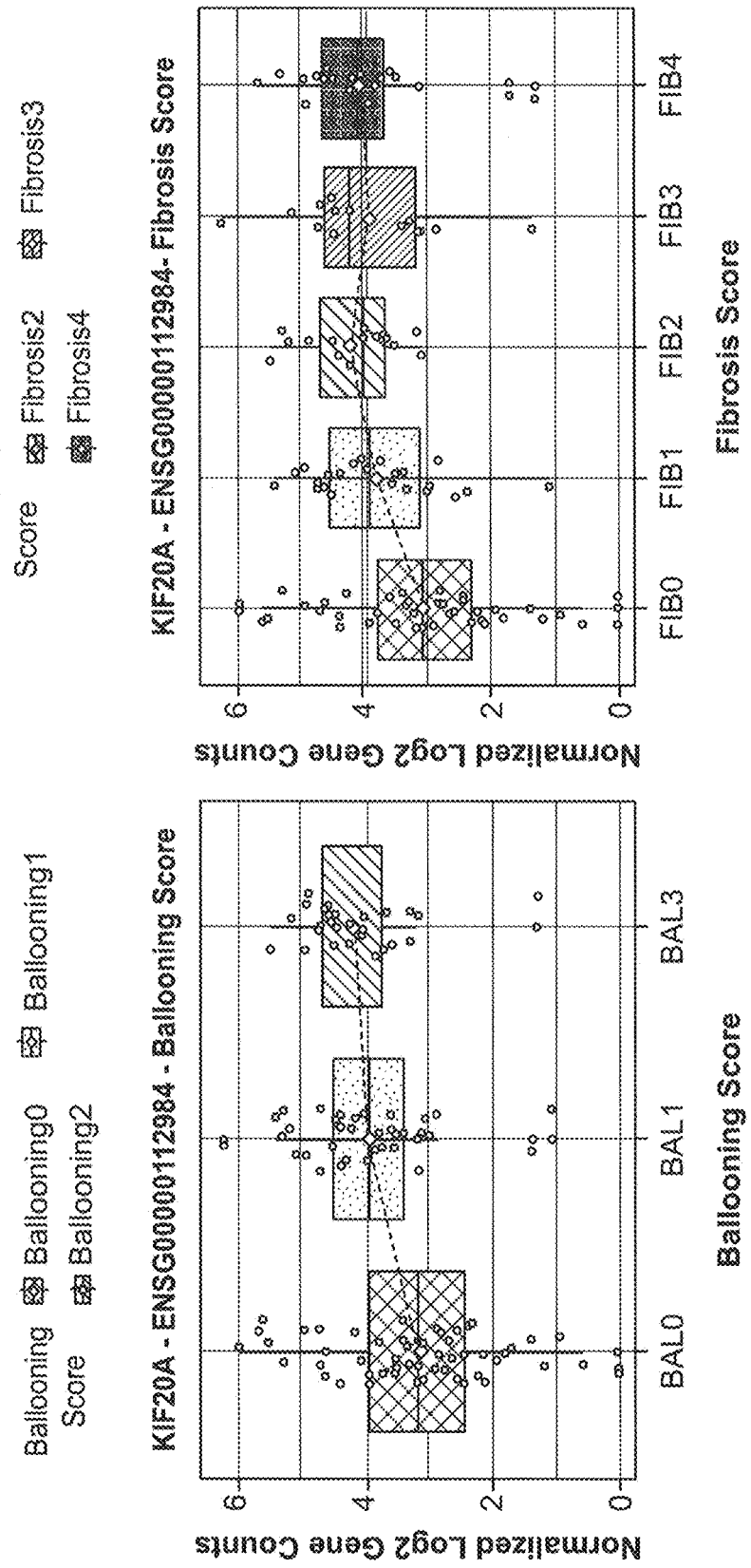

This target encodes a mitotic kinesin required for cytokinesis. In 3 out of 5 CDHFD mice, a strong enrichment for the shRNA targeting Kif20a compared to the control (FIG. 25A-25B; SEQ ID NO: 12) is seen. Based on the NAFLD patient cohort data, expression of Kif20a is increasing during disease progression (FIG. 25C-25E). Furthermore, high expression of Kif20a is associated with poor survival in case of HCC. Interestingly, Kif20a-knockdown affects cytokinesis leading to higher polyploidy. Higher polyploidy is also seen in many chronic liver diseases.

LTB—Lymphotoxin Beta

Figure 26A:
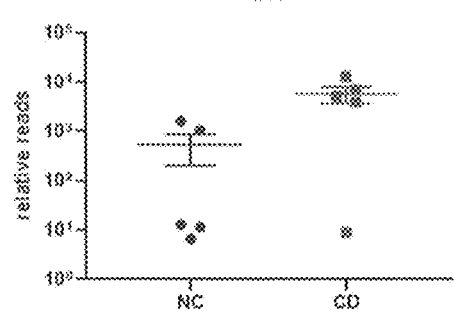
Figure 26B:
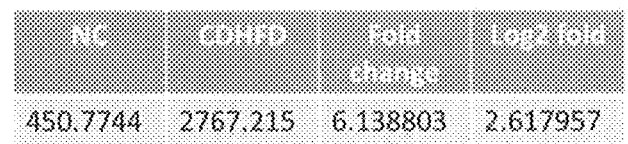
Figure 26D:
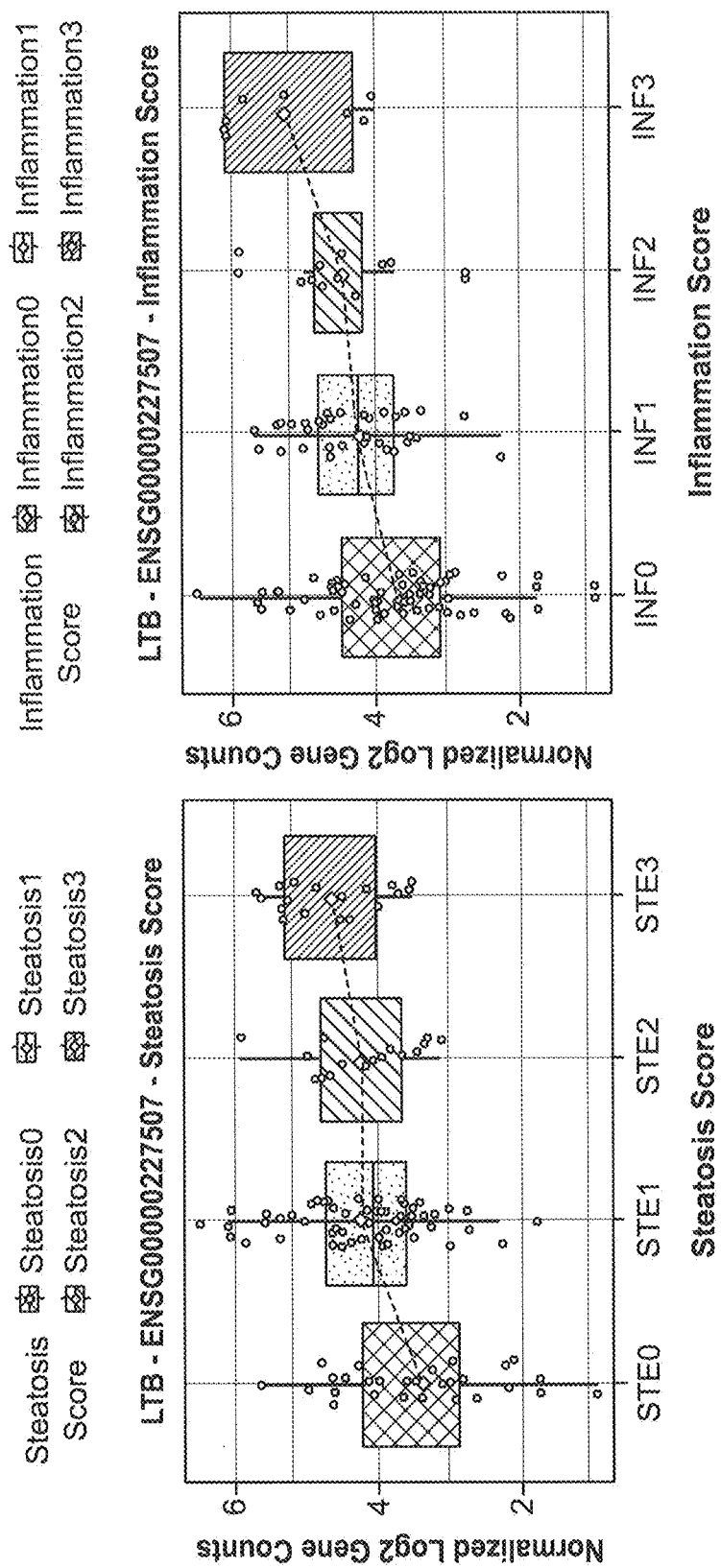
Figure 26E:
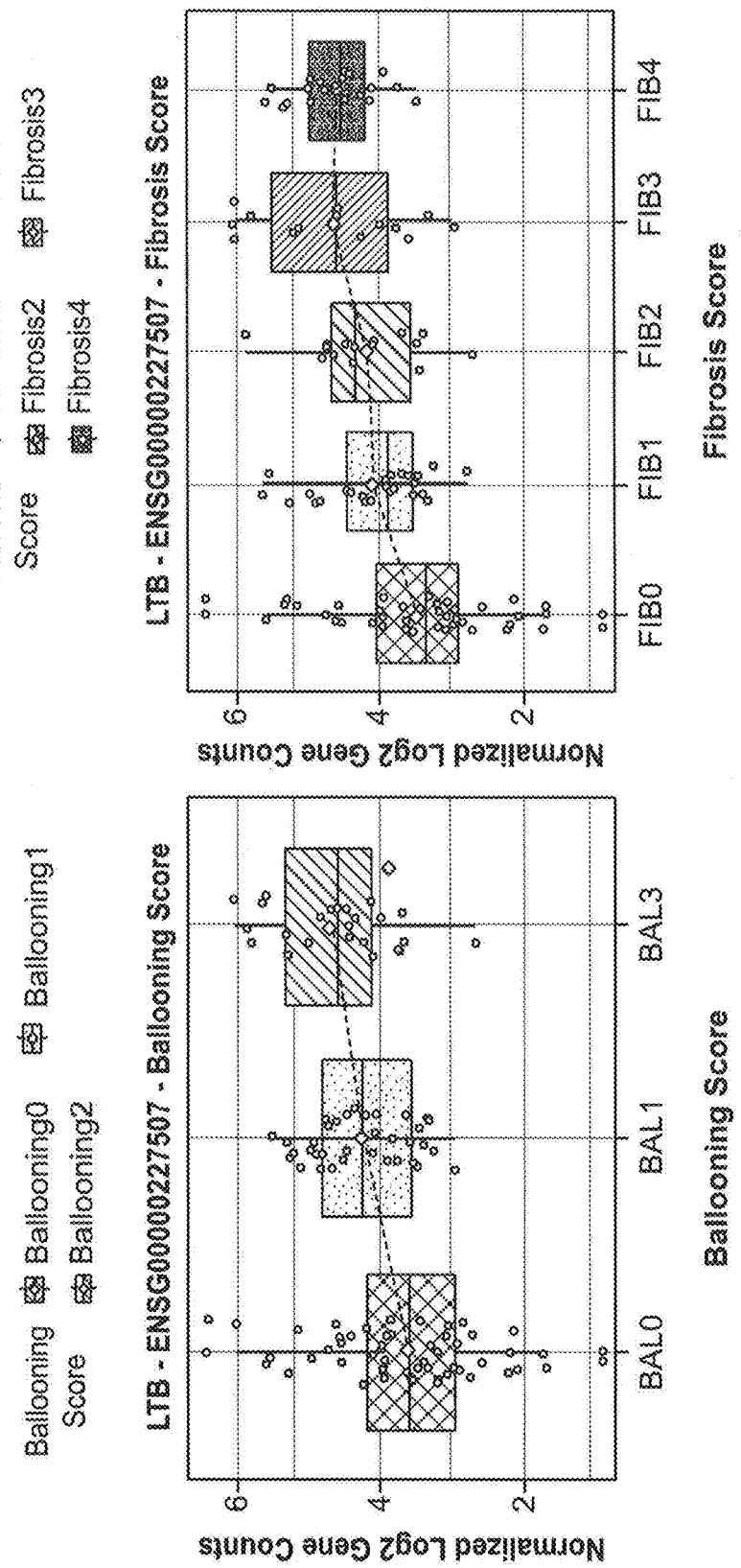

This target encodes a type II membrane protein of the TNF family. In 4 out of 5 CDHFD mice a strong enrichment for the shRNA targeting LTB compared to the control is seen (FIG. 26A-26B; SEQ ID NO: 10). Based on the NAFLD patient cohort data expression of LTB is consistently increasing during disease progression, except at the cirrhosis stage (FIG. 26C-26E). A significant expression increase based on steatosis, inflammation, ballooning and fibrosis score is also seen. Interestingly, LTB was found to regulate liver regeneration, is linked to obesity and animals lacking the lymphotoxin pathway were shown to resist diet-induced obesity.

Figure 27:
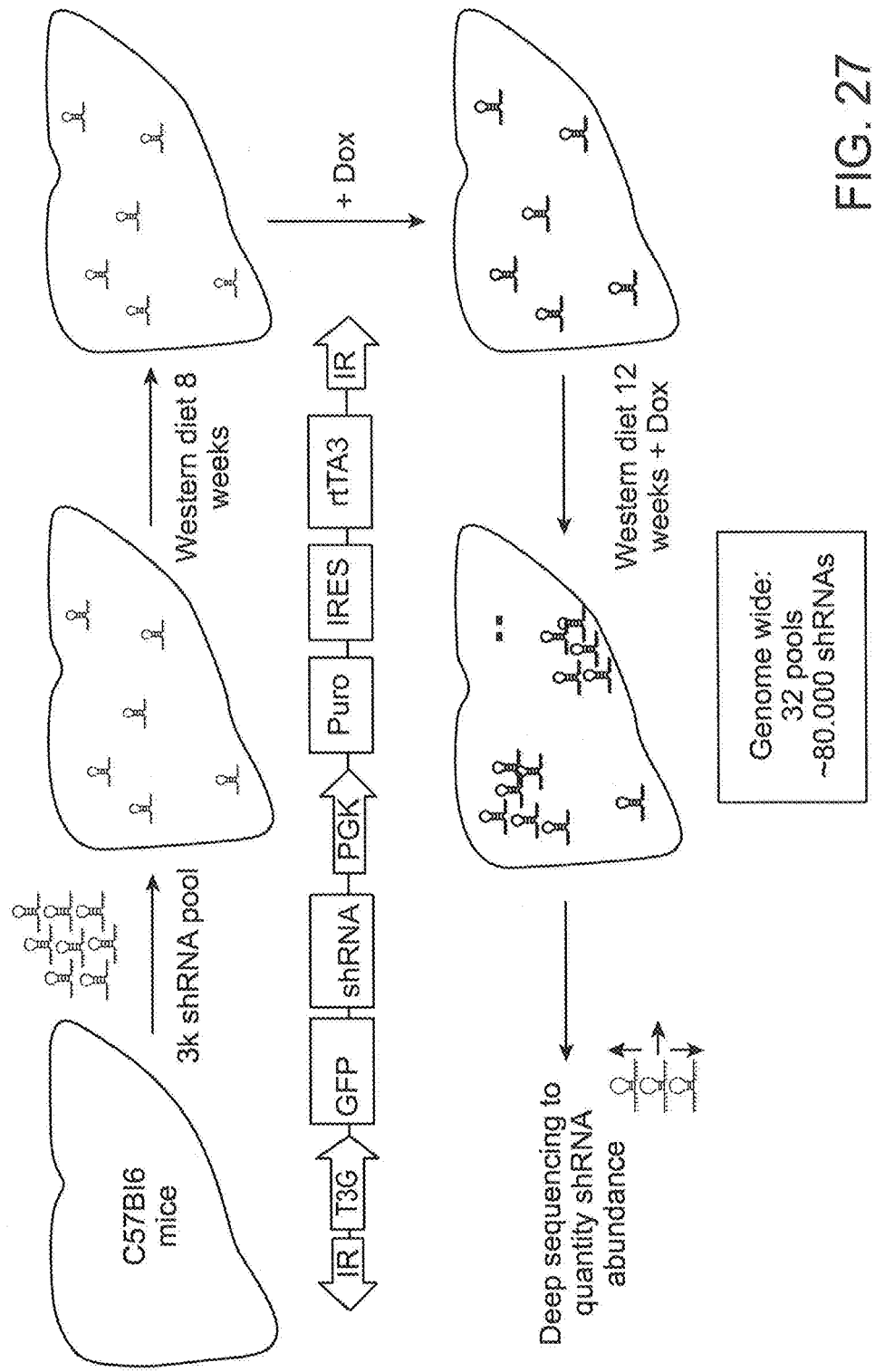
FIG. 27: Layout for NASH disease interception in vivo functional genetic screen FIG. 27) A genome wide in vivo functional genetic screen for disease interception. Nearly 80.000 shRNAs split into 32 sub-pools are screened. ShRNA expresses ion is inducible and only activated after liver shows steatosis but before NASH progression.

In addition, a functional genetic screen targeting the top down-regulated genes based on the NAFLD patient cohort is under the way. Also, a functional genomic screen is on the finishing line. In this set up, the inventors screen genome wide (32 shRNA pools of around 2500 to 3000 shRNAs in mice) specifically for modulators of NAFLD disease progression, by only inducing shRNA expression after steatosis is reached before progression to NASH (FIG. 27).

List of siRNA Guide Strands:

The siRNA guide strand is identical to the anti-sense strand of the sense-loop-anti-sense RNA structure. This sequence equals the reverse complement sequence of the targeting sequence in the mRNA. The list shows the 21 bp siRNA guide strand. SEQ ID NOs: 15 and 19 were used in the Examples. Light grey marked, bold and underlined are siRNA guide strands with top-DSIR prediction score and predicted by the genomewide sensor prediction algorithm (SEQ ID NOs: 349-351, 457, 465, 468, 470, 473, 1483, 1485, 1486, 1488-1490, 2209, 2225, 2234, 5061, 5062, 5390-5993, 5967, 5970, 5971, 6977, 6978 and 6993).

Sequence Identity

Pairwise and multiple sequence alignment for the purposes of determining percent identity between two or more amino acid or nucleic acid sequences can be achieved in various ways known to a person of skill in the art, for instance, using publicly available computer software such as ClustalOmega (Sdding, J. 2005, Bioinformatics 21, 951-960), T-coffee (Notredame et al. 2000, J. Mol. Biol. (2000) 302, 205-217), Kalign (Lassmann and Sonnhammer 2005, BMC Bioinformatics, 6(298)) and MAFFT (Katoh and Standley 2013, Molecular Biology and Evolution, 30(4) 772-780) software. When using such software, the default parameters, e.g. for gap penalty and extension penalty, are preferably used.

Tables

TABLE 1

Mouse (mus musculus):

| SEQ ID NO | siRNA_id | siRNA guide strand/AS Sequence |
|---|---|---|
| 1 | Mfap4.1356 | UUCAGAGUUGAGCAGUAGCCG |
| 2 | Mfap4.760 | UUGAGGGAGUAAUAGAAGCCU |
| 3 | Grhpr.361 | UUCUGCAGUGGCAUCUGUCAG |
| 4 | Grhpr.1024 | UACAGCUUGAGUUCGCUGGGC |
| 5 | Grhpr.1025 | UUACAGCUUGAGUUCGCUGGG |
| 6 | Iftg1.698 | UUAGAGGCAGUCAAUGUCGUG |
| 7 | Itfg1.680 | UUGAAGUCCAUAAUCAGUGGU |
| 8 | Abcc4 | UCGAAUUUGUUCACGUCGUUG |
| 9 | Pak3 | UGUGUAAACAGUUCCUGAUGC |
| 10 | Ltb | UCUGGUGUAGAAUCCGCAGCU |
| 11 | Apln | UCAAGGAGAGCCAGAGCAGCA |
| 12 | Kif20a | UAAUUGACUUGUUUCAUCUAG |
| 13 | Trnp1 | UGACUUAGUGGGGUCGGAGU |

Human (Homo sapiens):

TABLE 2

Results for MFAP4. Score threshold: 70. Design: siRNA 21 nt.

| SEQ ID NO | siRNA_id | siRNA guide strand/AS Sequence |
|---|---|---|
| 14 | 1 | AUAGAUGUCGUCACAGUCCAG |
| 15 | 2 | UAUUAUGUUAUUAUUACACUG |
| 16 | 3 | UUGUAGUCAUUCCAGCCGCGG |
| 17 | 4 | UUAUUGAGACCUUCAGUCCCU |
| 18 | 5 | UAGAACCAUGUGCCUCUCGGA |
| 19 | 6 | UAUUGAGACCUUCAGUCCCUA |
| 20 | 7 | UCACACUGCACUGCUCAGCUU |
| 21 | 8 | UUCUGCACCUGACUCCAGGUG |
| 22 | 9 | UCGAAGGUAGAGAACUUCUGG |
| 23 | 10 | UCAGCUUAGCACACUAGGGUG |
| 24 | 11 | UAGGACACCAUCAGCAGGGGA |
| 25 | 12 | UUUAUUGAGACCUUCAGUCCC |
| 26 | 13 | UUGGAGGCAACUCAUUCUCAU |
| 27 | 14 | UAUGUUAUUAUUACACUGUCU |
| 28 | 15 | UCGCAGCUCAUACUUCUGCUU |
| 29 | 16 | UAGAUGUCGUCACAGUCCAGG |
| 30 | 17 | UUAUGUUAUUAUUACACUGUC |
| 31 | 18 | UUGGUGCUCGGGAAUCAGCAG |
| 32 | 19 | UAAACCUCUCAACACCCAGAG |
| 33 | 20 | UAGUAGAAGCCCUUCCACUGG |
| 34 | 21 | UGUAAGGAGUUGGUGCUCGGG |
| 35 | 22 | AUCAGCAGAAGCAUGCAUCAG |
| 36 | 23 | UGUUAUUAUUACACUGUCUUU |
| 37 | 24 | UUCAUUCAGGUUCUGAAGGUU |
| 38 | 25 | UUCUGCACAAAGAGGUCCUGG |
| 39 | 26 | UCUCCAGAGCAUCUCCUCGGA |
| 40 | 27 | UUUGAGAGCAGCCCAGAGGAG |
| 41 | 28 | UUGAGGGAGUAGUAGAAGCCC |
| 42 | 29 | UAUGAUAGUGAGGUGGGCUGG |
| 43 | 30 | UAGAAUACACCAUGGGCCCUG |
| 44 | 31 | UGUAACUUCAGGUGUAGGGGA |
| 45 | 32 | UUGUAAGGAGUUGGUGCUCGG |
| 46 | 33 | UUGUUCUCAAAGUCCUCCAAG |
| 47 | 34 | UGAGGGAGUAGUAGAAGCCCU |
| 48 | 35 | UUCUGCUUCAGUGUCAGGAGG |

TABLE 2-continued

Results for MFAP4. Score threshold: 70. Design: siRNA 21 nt.

| SEQ ID NO | siRNA_id | siRNA guide strand/AS Sequence |
|---|---|---|
| 49 | 36 | AUACUUCUGCUUCAGUGUCAG |
| 50 | 37 | UUAUUAUUACACUGUCUUUUU |
| 51 | 38 | AUGUCGUCACAGUCCAGGGGU |
| 52 | 39 | AUGUUAUUAUUACACUGUCUU |
| 53 | 40 | UCUGCGCUGACCGCGUUCGGG |
| 54 | 41 | UUCCACGGUACUCACCACAGG |
| 55 | 42 | AAGGUUUAUUGAGACCUUCAG |
| 56 | 43 | UAAGGAGUUGGUGCUCGGGAA |
| 57 | 44 | UGUCAGGAGGUGCAUGUUCUG |
| 58 | 45 | AUUAUGUUAUUAUUACACUGU |
| 59 | 46 | UCCUCCUCUGCGCUGACCGCG |
| 60 | 47 | UGAAGGUUUAUUGAGACCUUC |
| 61 | 48 | AAGAUGGACCACAAAGGCCUG |
| 62 | 49 | UUCAGUGUCAGGAGGUGCAUG |
| 63 | 50 | UAGAUGAGGUACACGCCGUCU |
| 64 | 51 | UCAUACUUCUGCUUCAGUGUC |
| 65 | 52 | UUAGGAAUGGAUGCCCUGGGU |
| 66 | 53 | AUGGAGACCAUGGGUGUCCAG |
| 67 | 54 | UACUUCUGCUUCAGUGUCAGG |
| 68 | 55 | UUCAUGCUGUCAGUUCUGCUC |
| 69 | 56 | AAGCAGGACAAGAUGGACCAC |
| 70 | 57 | AUUCUCAUGGAGCCCAGCCAG |
| 71 | 58 | UGCGGAACCAGAAGGCUCCUG |
| 72 | 59 | AGAGAUUGUCCUCUGCUCCCU |
| 73 | 60 | AAGUCCUCCAAGUCCACUCGC |
| 74 | 61 | UCCAAGUCCACUCGCAGCUCA |
| 75 | 62 | UUCAGUCCCUACCCACUCCCA |
| 76 | 63 | UGUUCACACUGCACUGCUCAG |
| 77 | 64 | UAGGAAUGGAUGCCCUGGGUG |
| 78 | 65 | AACCUCUCAACACCCAGAGGG |
| 79 | 66 | UGGGCAUAGAUGUCGUCACAG |
| 80 | 67 | UGGGACAUGGUUUGAGAGCAG |
| 81 | 68 | UCCACGGUACUCACCACAGGG |
| 82 | 69 | AAGACCUCAUAUGCAUGCCUA |
| 83 | 70 | AGCUUGUAGUCAUUCCAGCCG |
| 84 | 71 | UCAUGCUGUCAGUUCUGCUCA |
| 85 | 72 | UGUUGGGACAGGUUGGAGGCA |
| 86 | 73 | AAGCUGAGUAUGAUAGUGAGG |
| 87 | 74 | UGUUGUUCUCAAAGUCCUCCA |
| 88 | 75 | UCUGCUUCAGUGUCAGGAGGU |
| 89 | 76 | UGUUUCAGGGUGGUGUGCGGU |
| 90 | 77 | UGUGCCUCUCGGAAGAGGCCU |
| 91 | 78 | UGUAGUCAUUCCAGCCGCGGA |
| 92 | 79 | UAUUAUUAUUAUGUUAUUAUU |
| 93 | 80 | UAUUAUUAUGUUAUUAUUACA |
| 94 | 81 | UCAGUCCCUACCCACUCCCAG |
| 95 | 82 | UUAUUAUGUUAUUAUUACACU |
| 96 | 83 | UAGGACAGGGAGUCACCUGCC |
| 97 | 84 | UACUCUCCAUCAGCACGGCCG |
| 98 | 85 | UGAGUAUGAUAGUGAGGUGGG |
| 99 | 86 | AUGGAGAAGUCAGCGUACUUG |
| 100 | 87 | AUGAUAGUGAGGUGGGCUGGG |
| 101 | 88 | UGGUAGGACAGGGAGUCACCU |
| 102 | 89 | UGUCAGUUCUGCUCAGAGUGG |
| 103 | 90 | UCUCAAAGUCCUCCAAGUCCA |
| 104 | 91 | UCUGAAGGUUUAUUGAGACCU |
| 105 | 92 | AUUAUUAUUGUUAUUAUUA |
| 106 | 93 | UACACGCCGUCUGACUGGUAG |
| 107 | 94 | UUGUCCUCUGCUCCCUCAUGU |
| 108 | 95 | UGUGAAAUACAAGGUUCCCUU |
| 109 | 96 | UCCUGGUCCCGGUCGAAGGUA |
| 110 | 97 | AGCAGAAGCAUGCAUCAGGGG |
| 111 | 98 | GAUGUCGUCACAGUCCAGGGG |
| 112 | 99 | AUGAGGUACACGCCGUCUGAC |
| 113 | 100 | UUUCAGGGUGGUGUGCGGUAG |
| 114 | 101 | UCCACAGUGAGGAAGCAGGAC |
| 115 | 102 | UUUGAGGGAGUAGUAGAAGCC |
| 116 | 103 | UCGGAUCCCGGAGACCUGGGG |
| 117 | 104 | UUCCCUUCUGCACCUGACUCC |
| 118 | 105 | UGCAGAGAUUGUCCUCUGCUC |
| 119 | 106 | AUCUCAGUGCGUUUGAGGGAG |
| 120 | 107 | UCGGUGGUCAUGUCACAGAAG |
| 121 | 108 | CUGAGUAUGAUAGUGAGGUGG |

TABLE 2-continued

Results for MFAP4. Score threshold: 70. Design: siRNA 21 nt.

| SEQ ID NO | siRNA_id | siRNA guide strand/AS Sequence |
|---|---|---|
| 122 | 109 | UGAAAUACAAGGUUCCCUUCU |
| 123 | 110 | AGGUUCUGAAGGUUUAUUGAG |
| 124 | 111 | UGGUCAUGUCACAGAAGACGG |
| 125 | 112 | UUCCAGCCGCGGAAGAAACUU |
| 126 | 113 | UGAUAGUGAGGUGGGCUGGGG |
| 127 | 114 | CAUGCUGUCAGUUCUGCUCAG |
| 128 | 115 | UCAGCUGUUGGGACAGGUUGG |
| 129 | 116 | ACAUGGUUUGAGAGCAGCCCA |
| 130 | 117 | UAAGUUGGUGGGAGGGAUGCU |
| 131 | 118 | CAAGGUUCCCUUCUGCACCUG |
| 132 | 119 | CUCAGCUUAGCACACUAGGGU |
| 133 | 120 | AGAGCAUCUCCUCGGAUCCCG |
| 134 | 121 | UCCUCGGAUCCCGGAGACCUG |
| 135 | 122 | CAUAGAUGUCGUCACAGUCCA |
| 136 | 123 | AACCAGAAGGCUCCUGAGGAG |
| 137 | 124 | CUUGUAGUCAUUCCAGCCGCG |
| 138 | 125 | AGGCCUGUGAAAUACAAGGUU |
| 139 | 126 | UCCCUUCUGCACCUGACUCCA |
| 140 | 127 | UGUGGUAGGACAGGGAGUCAC |
| 141 | 128 | UGAGGAAGCAGGACAAGAUGG |
| 142 | 129 | AGCAUCUCCUCGGAUCCCGGA |
| 143 | 130 | AGAACCAUGUGCCUCUCGGAA |
| 144 | 131 | UGGUGCUCGGGAAUCAGCAGA |
| 145 | 132 | GUUCUGCACAAAGAGGUCCUG |
| 146 | 133 | GUCGAAGGUAGAGAACUUCUG |
| 147 | 134 | AGGUACACGCCGUCUGACUGG |
| 148 | 135 | AACUCAUUCUCAUGGAGCCCA |
| 149 | 136 | AUGCUGAAGAUGGGACAUGGU |
| 150 | 137 | UGCUGAAGAUGGGACAUGGUU |
| 151 | 138 | UGCGCAGUUCUGCACAAAGAG |
| 152 | 139 | UAGCCCUGGGCAUAGAUGUCG |
| 153 | 140 | AAGACGGGCACAGGCACACUG |
| 154 | 141 | AUGCUGUCAGUUCUGCUCAGA |
| 155 | 142 | AAAGUCCUCCAAGUCCACUCG |
| 156 | 143 | AGUAGAAGCCCUUCCACUGGG |
| 157 | 144 | UGUCCUCUGCUCCCUCAUGUG |
| 158 | 145 | UCCACUCGCAGCUCAUACUUC |
| 159 | 146 | UCGGGAAUCAGCAGAAGCAUG |
| 160 | 147 | AUCAGCACGGCCGAAGCCCAG |
| 161 | 148 | GUUAUUAUUACACUGUCUUUU |
| 162 | 149 | UGCGCUGACCGCGUUCGGGGA |
| 163 | 150 | ACAAAGAGGUCCUGGUCCCGG |
| 164 | 151 | AAGUUGGUGGGAGGGAUGCUG |
| 165 | 152 | UGCACCUGACUCCAGGUGUAA |
| 166 | 153 | UGCACUGCUCAGCUUAGCACA |
| 167 | 154 | AGUCCUCCAAGUCCACUCGCA |
| 168 | 155 | UUCACACUGCACUGCUCAGCU |
| 169 | 156 | UCAUAUGCAUGCCUACCUUGG |
| 170 | 157 | UGAGGAGAGCUGCGCAGUU |
| 171 | 158 | CAGCUCAUACUUCUGCUUCAG |
| 172 | 159 | UGUCACAGAAGACGGGCACAG |
| 173 | 160 | AAACCUCUCAACACCCAGAGG |
| 174 | 161 | UCUGCACCUGACUCCAGGUGU |
| 175 | 162 | ACAGUGAGGAAGCAGGACAAG |
| 176 | 163 | UGGUUUGAGAGCAGCCCAGAG |
| 177 | 164 | UCUGACUGGUAGCCCUGGGCA |
| 178 | 165 | UCAUCUCAGUGCGUUUGAGGG |
| 179 | 166 | UGAAGAUGGGACAUGGUUUGA |
| 180 | 167 | CAGCUUAGCACACUAGGGUGG |
| 181 | 168 | UCUGCACAAAGAGGUCCUGGU |
| 182 | 169 | UGCCUCUCGGAAGAGGCCUGG |
| 183 | 170 | UGCUCAGCUUAGCACACUAGG |
| 184 | 171 | ACUUCUGCUUCAGUGUCAGGA |
| 185 | 172 | AUUAUUAUGUUAUUAUUACAC |
| 186 | 173 | UCAUGUCACAGAAGACGGGCA |
| 187 | 174 | AGAUGAGGUACACGCCGUCUG |
| 188 | 175 | GUUGUUCUCAAAGUCCUCCAA |
| 189 | 176 | UCAACACCCAGAGGGUAUGGG |
| 190 | 177 | AUUCAGGUUCUGAAGGUUUAU |
| 191 | 178 | CUGAAGGUUUAUUGAGACCUU |
| 192 | 179 | UGGAGAGAAGCAGCAGCAGCG |
| 193 | 180 | UCAAAGUCCUCCAAGUCCACU |
| 194 | 181 | UUGAGAGCAGCCCAGAGGAGU |

TABLE 2-continued

Results for MFAP4. Score threshold: 70. Design: siRNA 21 nt.

| SEQ ID NO | siRNA_id | siRNA guide strand/AS Sequence |
|---|---|---|
| 195 | 182 | UUGGUGGGAGGGAUGCUGAAG |
| 196 | 183 | UAGUCAUUCCAGCCGCGGAAG |
| 197 | 184 | AUGGACCACAAAGGCCUGCAG |
| 198 | 185 | AAUACAAGGUUCCCUUCUGCA |
| 199 | 186 | CAUGGUUUGAGAGCAGCCCAG |
| 200 | 187 | UCAUUCAGGUUCUGAAGGUUU |
| 201 | 188 | UUAUUAUUAUGUUAUUAUUAC |
| 202 | 189 | AGGCAACUCAUUCUCAUGGAG |
| 203 | 190 | UGGAGAAGUCAGCGUACUUGG |
| 204 | 191 | AGUACUCCAUCAGCACGGC |
| 205 | 192 | AUACAAGGUUCCCUUCUGCAC |
| 206 | 193 | ACUGCUCAGCUUAGCACACUA |
| 207 | 194 | CUAGAAUACACCAUGGGCCCU |
| 208 | 195 | UCAGCAGAAGCAUGCAUCAGG |
| 209 | 196 | UCCUGAGGAGAGCUGCGCA |
| 210 | 197 | AUCCUCCUCUGCGCUGACCGC |
| 211 | 198 | CUCCAGAGCAUCUCCUCGGAU |
| 212 | 199 | AGUGCCUUCAUGCUGUCAGUU |
| 213 | 200 | CACACUGCACUGCUCAGCUUA |
| 214 | 201 | CUCUCCAGAGCAUCUCCUCGG |
| 215 | 202 | AAAUACAAGGUUCCCUUCUGC |
| 216 | 203 | UGGAGGCAACUCAUUCUCAUG |
| 217 | 204 | UUCAGGUUCUGAAGGUUUAUU |
| 218 | 205 | CUGCUCAGCUUAGCACACUAG |
| 219 | 206 | CACAAAGAGGUCCUGGUCCCG |
| 220 | 207 | UACACCAUGGGCCCUGUUCAC |
| 221 | 208 | UCAGGAGGUGCAUGUUCUGCA |
| 222 | 209 | UGUCAGCUGUUGGGACAGGUU |
| 223 | 210 | AGCAGGGGAGCACUCAUGGA |
| 224 | 211 | GAGACCUUCAGUCCCUACCCA |
| 225 | 212 | ACUCGCAGCUCAUACUUCUGC |
| 226 | 213 | ACUCAUUCUCAUGGAGCCCAG |
| 227 | 214 | UGGUCCCGGUCGAAGGUAGAG |
| 228 | 215 | CUGUGAAAUACAAGGUUCCCU |
| 229 | 216 | UACCCACUCCCAGCCCUGCAG |
| 230 | 217 | UUCUCAAAGUCCUCCAAGUCC |
| 231 | 218 | AGCCGCGGAAGAAACUUACUG |
| 232 | 219 | AGAUGUCGUCACAGUCCAGGG |
| 233 | 220 | AGCACUCAUGGAGACCAUGGG |
| 234 | 221 | ACUCUCCAUCAGCACGGCCGA |
| 235 | 222 | CUUCAGUGUCAGGAGGUGCAU |
| 236 | 223 | GAAGCUGAGUAUGAUAGUGAG |
| 237 | 224 | CAGGAGGUGCAUGUUCUGCAG |
| 238 | 225 | CAUCUCAGUGCGUUUGAGGGA |
| 239 | 226 | AGUGUAACUUCAGGUGUAGGG |
| 240 | 227 | ACAAGGUUCCCUUCUGCACCU |
| 241 | 228 | AGGUUUAUUGAGACCUUCAGU |
| 242 | 229 | CUCCUCUGCGCUGACCGCGUU |
| 243 | 230 | AUUGUCCUCUGCUCCCUCAUG |
| 244 | 231 | CACUCGCAGCUCAUACUUCUG |
| 245 | 232 | UCCACUUCCCGCCCUCGGUGG |
| 246 | 233 | CAGGCUAGAACCAUGUGCCUC |
| 247 | 234 | AAAGAGGUCCUGGUCCCGGUC |
| 248 | 235 | CUCGGGAAUCAGCAGAAGCAU |
| 249 | 236 | ACGGGCACAGGCACACUGGGG |
| 250 | 237 | CUCUCCAUCAGCACGGCCGAA |
| 251 | 238 | UCAGGUUCUGAAGGUUUAUUG |
| 252 | 239 | AGUUCUGCACAAAGAGGUCCU |
| 253 | 240 | UAGAAGCCCUUCCACUGGGCC |
| 254 | 241 | AGUAUGAUAGUGAGGUGGGCU |
| 255 | 242 | ACAGGUUGGAGGCAACUCAUU |
| 256 | 243 | ACCAUGUGCCUCUCGGAAGAG |
| 257 | 244 | AGCUGUUUGGGACAGGUUGGAG |
| 258 | 245 | ACCUCCAGAGCAUCUCCUC |
| 259 | 246 | UCCUCUGCGCUGACCGCGUUC |
| 260 | 247 | GGUCAUGUCACAGAAGACGGG |
| 261 | 248 | AUGGUUUGAGAGCAGCCCAGA |
| 262 | 249 | UCAGGGUGGUGUGCGGUAGCU |
| 263 | 250 | UACAAGGUUCCCUUCUGCACC |
| 264 | 251 | AAGAGGUCCUGGUCCCGGUCG |
| 265 | 252 | UCCAGCCGCGGAAGAAACUUA |
| 266 | 253 | CUCAUAUGCAUGCCUACCUUG |
| 267 | 254 | AAGGUUCCCUUCUGCACCUGA |

TABLE 2-continued

Results for MFAP4. Score threshold: 70. Design: siRNA 21 nt.

| SEQ ID NO | siRNA_id | siRNA guide strand/AS Sequence |
|---|---|---|
| 268 | 255 | UGCUGUCAGUUCUGCUCAGAG |
| 269 | 256 | AACACCCAGAGGGUAUGGGGA |
| 270 | 257 | GUAGAUGAGGUACACGCCGUC |
| 271 | 258 | UAGGCCGUGUUGUUCUCAAAG |
| 272 | 259 | AGAUGGGACAUGGUUUGAGAG |
| 273 | 260 | UUCCACUGGGCCCAGUUGAUG |
| 274 | 261 | CAGCUGUUGGGACAGGUUGGA |
| 275 | 262 | AGCCCUGCAGAGAUUGUCCUC |
| 276 | 263 | CAUACUUCUGCUUCAGUGUCA |
| 277 | 264 | UUCUGAAGGUUUAUUGAGACC |
| 278 | 265 | AGGACAGGGAGUCACCUGCCC |
| 279 | 266 | ACAAGAUGGACCACAAAGGCC |
| 280 | 267 | AGAGGUCCUGGUCCCGUCGA |
| 281 | 268 | AGCUGAGUAUGAUAGUGAGGU |
| 282 | 269 | UCCCUACCCACUCCCAGCCCU |
| 283 | 270 | AGGCUCCUGAGGAGAGAGCUG |
| 284 | 271 | AGACCAUGGGUGUCCAGGGA |
| 285 | 272 | GUCCACUCGCAGCUCAUACUU |
| 286 | 273 | AUUGAGACCUUCAGUCCCUAC |
| 287 | 274 | AUGAGGCCUGUGAAAUACAAG |
| 288 | 275 | UCACAGAAGACGGGCACAGGC |
| 289 | 276 | AGAUUGUCCUCUGCUCCCUCA |
| 290 | 277 | AGACCUUCAGUCCCUACCCAC |
| 291 | 278 | CUGUUCACACUGCACUGCUCA |
| 292 | 279 | GUAGGACACCAUCAGCAGGGG |
| 293 | 280 | GUGUAACUUCAGGUGUAGGGG |
| 294 | 281 | GAGACCAUGGGUGUCCAGGGG |
| 295 | 282 | CAACUCAUUCUCAUGGAGCCC |
| 296 | 283 | CUGACUGGUAGCCCUGGGCAU |
| 297 | 284 | GGAAGAAACUUACUGAGCCAU |
| 298 | 285 | CGGAAGAAACUUACUGAGCCA |
| 299 | 286 | CUGUCAGUUCUGCUCAGAGUG |
| 300 | 287 | CCCAGCUUGUAGUCAUUCCAG |
| 301 | 288 | AAGCCCUUCCACUGGGCCCAG |
| 302 | 289 | GUACACGCCGUCUGACUGGUA |
| 303 | 290 | GCUAAACCUCUCAACACCCAG |
| 304 | 291 | AGAAGCAGCAGCAGCGGCAGG |
| 305 | 292 | UCAGUGUCAGGAGGUGCAUGU |
| 306 | 293 | AGAGAAGCAGCAGCAGCGGCA |
| 307 | 294 | UGACUGGUAGCCCUGGGCAUA |
| 308 | 295 | CUGCUUCAGUGUCAGGAGGUG |
| 309 | 296 | CACGGUACUCACCACAGGGGA |
| 310 | 297 | CUCGGUGGUCAUGUCACAGAA |
| 311 | 298 | AAGGAGUUGGUGCUCGGGAAU |
| 312 | 299 | GAGUAUGAUAGUGAGGUGGGC |
| 313 | 300 | GGAAUCAGCAGAAGCAUGCAU |
| 314 | 301 | CUAGAACCAUGUGCCUCUCGG |
| 315 | 302 | CUCGCAGCUCAUACUUCUGCU |
| 316 | 303 | UGCUUCAGUGUCAGGAGGUGC |
| 317 | 304 | UCCUCCAAGUCCACUCGCAGC |
| 318 | 305 | AGGAGUGCCUUCAUGCUGUCA |
| 319 | 306 | GUCCUCCAAGUCCACUCGCAG |
| 320 | 307 | ACACUGCACUGCUCAGCUUAG |
| 321 | 308 | GAGUAGUAGAAGCCCUUCCAC |
| 322 | 309 | GUAGUCAUUCCAGCCGCGGAA |
| 323 | 310 | CUGCAGAGAUUGUCCUCUGCU |
| 324 | 311 | AUGGGCCCUGUUCACACUGCA |
| 325 | 312 | AUAGGCCGUGUUGUUCUCAAA |
| 326 | 313 | AUGGGACAUGGUUUGAGAGCA |
| 327 | 314 | GAGGGAGUAGUAGAAGCCCUU |
| 328 | 315 | GACAGGUUGGAGGCAACUCAU |
| 329 | 316 | CCUCAUAUGCAUGCCUACCUU |
| 330 | 317 | AAUCAGCAGAAGCAUGCAUCA |
| 331 | 318 | CCAGGCUAGAACCAUGUGCCU |
| 332 | 319 | UGCACAAAGAGGUCCUGGUCC |
| 333 | 320 | CGUGGAGAGAAGCAGCAGCAG |
| 334 | 321 | CUGCACCUGACUCCAGGUGUA |
| 335 | 322 | CUCCAAGUCCACUCGCAGCUC |
| 336 | 323 | AGUAGUAGAAGCCCUUCCACU |
| 337 | 324 | UCAGUGCGUUUGAGGGAGUAG |
| 338 | 325 | GGUAGGACAGGGAGUCACCUG |
| 339 | 326 | CAGGGUGGUGUGCGGUAGCUG |
| 340 | 327 | AGACGGGCACAGGCACACUGG |

TABLE 2-continued

Results for MFAP4. Score threshold: 70. Design: siRNA 21 nt.

| SEQ ID NO | siRNA_id | siRNA guide strand/AS Sequence |
|---|---|---|
| 341 | 328 | CACAGUGAGGAAGCAGGACAA |
| 342 | 329 | CUUCAUGCUGUCAGUUCUGCU |
| 343 | 330 | GGAGAGAAGCAGCAGCAGCGG |
| 344 | 331 | UGAGGUACACGCCGUCUGACU |
| 345 | 332 | CUCCUGAGGAGAGAGCUGCGC |
| 346 | 333 | AUCUCCUCGGAUCCCGGAGAC |
| 347 | 334 | UGAGACCUUCAGUCCCUACCC |

TABLE 3

Results for GRHPR. Score threshold: 70. Design: siRNA 21 nt.

| SEQ ID NO | siRNA_id | siRNA guide strand/AS Sequence |
|---|---|---|
| 348 | 1 | UUCUGGGCUCGUCACAUCCAG |
| 349 | 2 | UGAUGUUGAUGAACACAGCUG |
| 350 | 3 | AUGUUGAUGAACACAGCUGUU |
| 351 | 4 | UAGACACAAACUCUGCCUGGA |
| 352 | 5 | UUCUGGAAGAAGUCCUUGUUG |
| 353 | 6 | UUGUUGCAGAGUCCCUCGGUU |
| 354 | 7 | UCACAUCCAGUCCAGCAGCUG |
| 355 | 8 | AUCUUCUGGAAGAAGUCCUUG |
| 356 | 9 | UGGAAGAAGUCCUUGUUGCAG |
| 357 | 10 | UUUGUAGGCAGUGGUUCUGGG |
| 358 | 11 | UGUUGAUGAACACAGCUGUUU |
| 359 | 12 | AAUCUCUGGACACCGAAUGGU |
| 360 | 13 | UUCUGCUGCUUCCUCAGGCCU |
| 361 | 14 | UACAGAAAUCUCUGGACACCG |
| 362 | 15 | UCGUCACAUCCAGUCCAGCAG |
| 363 | 16 | UUGAUGAACACAGCUGUUUCC |
| 364 | 17 | UUGCAGAGUCCCUCGGUUGCA |
| 365 | 18 | UGAUGAACACAGCUGUUUCCU |
| 366 | 19 | UCAUCUUCUGGAAGAAGUCCU |
| 367 | 20 | UCUGCUGCUUCCUCAGGCCUG |
| 368 | 21 | UCGGUUGCAGGUGUUAAGGAG |
| 369 | 22 | UUGUAGGCAGUGGUUCUGGGC |
| 370 | 23 | UUCCUUCAUCUUCUGGAAGAA |
| 371 | 24 | UCUGCCUGGAAUUCUGCUGCU |
| 372 | 25 | UUCUUCAGGGUCAGGAGAGGG |
| 373 | 26 | UGGAAUUCUGCUGCUUCCUCA |
| 374 | 27 | AGCUGUUUCCUUCAUCUUCUG |
| 375 | 28 | UGUUUCCUUCAUCUUCUGGAA |
| 376 | 29 | UUCAUCUUCUGGAAGAAGUCC |
| 377 | 30 | AUGAACACAGCUGUUUCCUUC |
| 378 | 31 | ACAGAAAUCUCUGGACACCGA |
| 379 | 32 | UUGCAGGUGUUAAGGAGCAGG |
| 380 | 33 | UCUCUGGACACCGAAUGGUUU |
| 381 | 34 | UCUUCUGGAAGAAGUCCUUGU |
| 382 | 35 | UGGUACAGGUCGUCCUGGUUU |
| 383 | 36 | CUGAUGUUGAUGAACACAGCU |
| 384 | 37 | GUAGACACAAACUCUGCCUGG |
| 385 | 38 | AUGGUUUCAGAGCCGAGCAA |
| 386 | 39 | AACUCUGCCUGGAAUUCUGCU |
| 387 | 40 | AUCUCUGGACACCGAAUGGUU |
| 388 | 41 | UAGGCAGUGGUUCUGGGCUCG |
| 389 | 42 | UGUACAGAAAUCUCUGGACAC |
| 390 | 43 | UGUUGCAGAGUCCCUCGGUUG |
| 391 | 44 | UGCUGAUGUUGAUGAACACAG |
| 392 | 45 | UUCAGGGUCAGGAGAGGGUGG |
| 393 | 46 | CUUGUUGCAGAGUCCCUCGGU |
| 394 | 47 | ACUCUGCCUGGAAUUCUGCUG |
| 395 | 48 | CAGAAAUCUCUGGACACCGAA |
| 396 | 49 | UGAAAUCAGAUUGGGCAGCCA |
| 397 | 50 | CAUCUUCUGGAAGAAGUCCUU |
| 398 | 51 | UGCAGAGUCCCUCGGUUGCAG |
| 399 | 52 | AGUCCUUGUUGCAGAGUCCCU |
| 400 | 53 | AAGUCCUUGUUGCAGAGUCCC |
| 401 | 54 | UCCUGGUUUACGACGUCGCCC |
| 402 | 55 | GAUGUUGAUGAACACAGCUGU |
| 403 | 56 | AAAUCUCUGGACACCGAAUGG |
| 404 | 57 | UCAGGGUCAGGAGAGGGUGGU |
| 405 | 58 | UUUCCUUCAUCUUCUGGAAGA |
| 406 | 59 | AAGAAGUCCUUGUUGCAGAGU |
| 407 | 60 | CUGCCUGGAAUUCUGCUGCUU |

TABLE 3-continued

Results for GRHPR. Score threshold: 70. Design: siRNA 21 nt.

| SEQ ID NO | siRNA_id | siRNA guide strand/AS Sequence |
|---|---|---|
| 408 | 61 | UCGUCCUGGUUUACGACGUCG |
| 409 | 62 | UGAACACAGCUGUUUCCUUCA |
| 410 | 63 | GAACACAGCUGUUUCCUUCAU |
| 411 | 64 | CAGUCCAGCAGCUGCAAUCUU |
| 412 | 65 | ACAUCCAGUCCAGCAGCUGCA |
| 413 | 66 | UCCUUGUUGCAGAGUCCCUCG |
| 414 | 67 | AGACACAAACUCUGCCUGGAA |
| 415 | 68 | AGUCCAGCAGCUGCAAUCUUA |
| 416 | 69 | AAUUCUGCUGCUUCCUCAGGC |
| 417 | 70 | UGCUGCUUCCUCAGGCCUGGG |
| 418 | 71 | ACAGCUGUUUCCUUCAUCUUC |
| 419 | 72 | CUUCUGGAAGAAGUCCUUGUU |
| 420 | 73 | AAACUCUGCCUGGAAUUCUGC |
| 421 | 74 | CACAGCUGUUUCCUUCAUCUU |
| 422 | 75 | UCUGGGCUCGUCACAUCCAGU |
| 423 | 76 | AUCCAGUCCAGCAGCUGCAAU |
| 424 | 77 | AGCAGCUGCAAUCUUACCACU |
| 425 | 78 | UGCUUCCUCAGGCCUGGGCUG |
| 426 | 79 | UGUAGGCAGUGGUUCUGGGCU |
| 427 | 80 | UACAGGUCGUCCUGGUUUACG |
| 428 | 81 | CAUCCAGUCCAGCAGCUGCAA |
| 429 | 82 | AGAGUCCCUCGGUUGCAGGUG |
| 430 | 83 | UCUUCAGGGUCAGGAGAGGGU |
| 431 | 84 | UCCUUCAUCUUCUGGAAGAAG |
| 432 | 85 | CCUUGUUGCAGAGUCCCUCGG |
| 433 | 86 | AACACAGCUGUUUCCUUCAUC |
| 434 | 87 | AGUCCCUCGGUUGCAGGUGUU |
| 435 | 88 | GUUGCAGGUGUUAAGGAGCAG |
| 436 | 89 | UCUGGAAGAAGUCCUUGUUGC |
| 437 | 90 | GAUGAACACAGCUGUUUCCUU |
| 438 | 91 | CUGGUUUACGACGUCGCCCCU |
| 439 | 92 | CUGGUACAGGUCGUCCUGGUU |
| 440 | 93 | CUGUUUCCUUCAUCUUCUGGA |
| 441 | 94 | AGGCCUGGUACAGGUCGUCCU |
| 442 | 95 | ACGACGAUGAAAUCAGAUUGG |
| 443 | 96 | AUUCUGCUGCUUCCUCAGGCC |
| 444 | 97 | CAGCUGCAAUCUUACCACUGG |
| 445 | 98 | GCAGCUGCAAUCUUACCACUG |
| 446 | 99 | AGUUCUUCAGGGUCAGGAGAG |
| 447 | 100 | ACCGAAUGGUUUCAGACGCCG |
| 448 | 101 | ACAGUUCUUCAGGGUCAGGAG |
| 449 | 102 | GUCCUUGUUGCAGAGUCCCUC |
| 450 | 103 | GCUGUUUCCUUCAUCUUCUGG |
| 451 | 104 | AAUGGUUUCAGACGCCGAGCA |
| 452 | 105 | UCUGGACACCGAAUGGUUUCA |
| 453 | 106 | ACAAACUCUGCCUGGAAUUCU |
| 454 | 107 | UGGUUUGUAGGCAGUGGUUCU |
| 455 | 108 | CAAACUCUGCCUGGAAUUCUG |
| 456 | 109 | CUGCUGAUGUUGAUGAACACA |

TABLE 4

Results for ITFG1. Score threshold: 70. Design: siRNA 21 nt.

| SEQ ID NO | siRNA_id | siRNA guide strand/AS Sequence |
|---|---|---|
| 457 | 1 | UAUAAAUACACAAACACUGGA |
| 458 | 2 | UAGAUCACCAUUGAAAUCCAU |
| 459 | 3 | UAGAAUAAGAAGCAAGACCAA |
| 460 | 4 | UUGCAUUGAAGUCUGAAUGUA |
| 461 | 5 | UUGACCACUUACUCUGUGCUA |
| 462 | 6 | UUAAUGUUUACAGUAACUCAA |
| 463 | 7 | UAUACAUGAUAUAAGGUCCAG |
| 464 | 8 | UUAUCUUACGAGGACAGUCAU |
| 465 | 9 | UUAUAAAUACACAAACACUGG |
| 466 | 10 | UUUAGGUCUGUCAGCUCCCAG |
| 467 | 11 | UAUCAAUGCACUGUGAUUCUU |
| 468 | 12 | UAUUGCUGAAAUCUUGUAGGA |
| 469 | 13 | AUAUUGACCACUUACUCUGUG |
| 470 | 14 | UACUUGUAGUGGUCAAUGCUG |
| 471 | 15 | UUACUCUGUGCUAGGCACCAA |
| 472 | 16 | AUUUAUUUGAAUACUUUCCAA |
| 473 | 17 | UAUGGAAUGACAAUUAGCUGG |
| 474 | 18 | UAGGACUGGAACCCACUGCUU |
| 475 | 19 | UAAUAUGAGCAAGUAAAUCUU |

TABLE 4-continued

Results for ITFG1.
Score threshold: 70. Design: siRNA 21 nt.

| SEQ ID NO | siRNA_id | siRNA guide strand/ AS Sequence |
|---|---|---|
| 476 | 20 | UAAGUCUAAUAAGAUCAUCUA |
| 477 | 21 | UUUACUUAGCACUACAAUGUC |
| 478 | 22 | UUAUAGACUUCUCCAAGUGUU |
| 479 | 23 | UGACCUGCUGUGAUGAAGCUG |
| 480 | 24 | AUACUUUCCAAUAAUUACCAU |
| 481 | 25 | UUGCGCUCCGACCUAAACCAA |
| 482 | 26 | UAGACUUUAAACAUUCGACGC |
| 483 | 27 | UUAUUAGCAUUGAUAAACUUU |
| 484 | 28 | UAGAACACAGACCACUAAGAA |
| 485 | 29 | UUCUUUAGUAUGACCAGAGCG |
| 486 | 30 | UAGCACUACAAUGUCCAAGAU |
| 487 | 31 | UGAGUAUGGUCAUAUUGUUA |
| 488 | 32 | UAUAGCAGUAAGCAGAACAAU |
| 489 | 33 | UGACUGUCCAACCACCAUCAU |
| 490 | 34 | AAUCUUUAUGUCAAUCACCAA |
| 491 | 35 | AUUAUUAGCAUUGAUAAACUU |
| 492 | 36 | UAUUGUAGUCUCCAAUAUGAA |
| 493 | 37 | UUAGUAUGACCAGAGCGUCUG |
| 494 | 38 | AUAAAUACACAAACACUGGAG |
| 495 | 39 | UUGAAUUAGGAGUUUAAGGCA |
| 496 | 40 | UUGUAGGACUGGAACCCACUG |
| 497 | 41 | UAGGAGUUUAAGGCAAGUCUG |
| 498 | 42 | UAUCAGGAAUUAGAUCACCAU |
| 499 | 43 | UCGUCAGGAAUAAAUCUGCUG |
| 500 | 44 | UUGAUUUAGGUCUGUCAGCUC |
| 501 | 45 | UAUUUAUUUGAAUACUUUCCA |
| 502 | 46 | UAUUUCUAUAAUUAGAUGUAU |
| 503 | 47 | UUGUAGUGGUCAAUGCUGGAU |
| 504 | 48 | UGGAAUGACAAUUAGCUGGGA |
| 505 | 49 | UUGUAUAUCCUUUACUUAGCA |
| 506 | 50 | AUUAUAAAUACACAAACACUG |
| 507 | 51 | UAUAGUACUGACAGAGAAGUU |
| 508 | 52 | UAAACAUUCGACGCGCCUCUU |
| 509 | 53 | AUUAAUAAUGACAACUACCAC |
| 510 | 54 | UUGUAUCAAUGCACGUGAU |
| 511 | 55 | UAUCAAGUCUAUGUAUUUCUA |
| 512 | 56 | UUGGAGAGCUAAAUGUGCGGA |
| 513 | 57 | UUUCCAAUAAUUACCAUGGGA |
| 514 | 58 | UAUUGUUAGGAUCUAAUGUUU |
| 515 | 59 | UAGUAUGACCAGAGCGUCUGG |
| 516 | 60 | UUAAUAAUGACAACUACCACA |
| 517 | 61 | UAAGGCAAGUCUGUCUUACUG |
| 518 | 62 | AAGUCUAAUAAGAUCAUCUAA |
| 519 | 63 | UAAGCAGAACAAUAUUACUUG |
| 520 | 64 | UUGAAAGAUACCUUUACUUUG |
| 521 | 65 | UACUGUGCUACCAAGUCAGAG |
| 522 | 66 | UAAGCACUUCACAUACAUCAU |
| 523 | 67 | UUUGGAAUGAUUGCAGUCCAC |
| 524 | 68 | UAUAAUUAGAUGUAUAAGUCU |
| 525 | 69 | UAAUUAGAUGUAUAAGUCUAA |
| 526 | 70 | UAAAUUAUAGACUUCUCCAAG |
| 527 | 71 | AUAUGUCAGAAGGACAUCCAU |
| 528 | 72 | UCUUUGUAUAUCCUUUACUUA |
| 529 | 73 | UUGGAGAGUACUAUAAUUUUU |
| 530 | 74 | UUAAUUCUUGGAGAGUACUAU |
| 531 | 75 | AUAAUUAGAUGUAUAAGUCUA |
| 532 | 76 | UAAGAAGCAAGACCAAGUCAA |
| 533 | 77 | UAGGGCACAUUAAUUCUUGGA |
| 534 | 78 | UCUGUCUUACUGUGCUACCAA |
| 535 | 79 | UUCUUUGUAUAUCCUUUACUU |
| 536 | 80 | UUAUAAAUAAUAUUUAAUCUC |
| 537 | 81 | UACAUCAUCCCAUUUAAUGUU |
| 538 | 82 | UUGCAUUAUUACAAGGGACGU |
| 539 | 83 | UAAUAAUGACAACUACCACAU |
| 540 | 84 | UUUGAUUUAGGUCUGUCAGCU |
| 541 | 85 | UUUCAGUUGGUUGCUGUUCAU |
| 542 | 86 | UGAUUCUUGAAAGAUACCUUU |
| 543 | 87 | UUGGUUGCUGUUCAUCCACAA |
| 544 | 88 | UUGCAUUCCCAGAUGCUGCCU |
| 545 | 89 | UAUAUCCUUUACUUAGCACUA |
| 546 | 90 | AAUGAUUGCAGUCCACUCUUG |
| 547 | 91 | UUGUAUACAUGAUAUAAGGUC |
| 548 | 92 | UUCAACUAAUCAAGUGAACAG |
| 549 | 93 | UUAAAGGCAAGUCACAUAGCA |

TABLE 4-continued

Results for ITFG1.
Score threshold: 70. Design: siRNA 21 nt.

| SEQ ID NO | siRNA_id | siRNA guide strand/ AS Sequence |
|---|---|---|
| 550 | 94 | UUACAGUAACUCAAGUAUUAG |
| 551 | 95 | AAUAUGAGCAAGUAAAUCUUU |
| 552 | 96 | AAUAAUGACAACUACCACAUA |
| 553 | 97 | AUGUCGUCAGGAAUAAAUCUG |
| 554 | 98 | UAUCUUACGAGGACAGUCAUU |
| 555 | 99 | UUACUUAGCACUACAAUGUCC |
| 556 | 100 | AUUUAGGUCUGUCAGCUCCCA |
| 557 | 101 | UUUAUUUGAAUACUUUCCAAU |
| 558 | 102 | UCGAGGGACAUUGUGAGGGUA |
| 559 | 103 | UUCCAUCUUCGUAAAUGUCAA |
| 560 | 104 | AAGAAUAUUUCUUCAUGCCUG |
| 561 | 105 | AUCUUGUAGGACUGGAACCCA |
| 562 | 106 | UACUUAGCACUACAAUGUCCA |
| 563 | 107 | UAAUUGGAAUUGGUAUUUCAG |
| 564 | 108 | UUUAAUGUUUACAGUAACUCA |
| 565 | 109 | UUGCUGUUCAUCCACAAAUGG |
| 566 | 110 | UGAAUGCCUAAUGACUCCGUG |
| 567 | 111 | UCAAACUGGAAGGUACUAGUG |
| 568 | 112 | AACAGCUCCUAAUUCACUCUU |
| 569 | 113 | UCCAAUAUAGUACUGACAGAG |
| 570 | 114 | UUCAAGAAAUCAAAUGUUCUU |
| 571 | 115 | UUAAGAAGACAUGUUAACAUG |
| 572 | 116 | UAAAGGCAAGUCACAUAGCAU |
| 573 | 117 | UACACAAACACUGGAGUACAU |
| 574 | 118 | UGAAUUAGGAGUUUAAGGCAA |
| 575 | 119 | AAUUUGAUUUAGGUCUGUCAG |
| 576 | 120 | UUUACAGAGGUUAAACAAGAG |
| 577 | 121 | AAGAACAAUAACUUUAACAAA |
| 578 | 122 | UAAAUAAUAUUUAAUCUCCCC |
| 579 | 123 | AUAUUGUUAGGAUCUAAUGUU |
| 580 | 124 | UAUUUAUUAAGAAGACAUGUU |
| 581 | 125 | UAGAUGUAUAAGUCUAAUAAG |
| 582 | 126 | UAAGUAGAUGGUACUCUUUUG |
| 583 | 127 | AACUAAUCAAGUGAACAGCCA |
| 584 | 128 | UACAUGCAACACAUUCCACAA |
| 585 | 129 | UUUGCAUUGAAGUCUGAAUGU |
| 586 | 130 | UUUGAGAAUAGAAAUGUGAUU |
| 587 | 131 | UAAGUGGUUGAAUUAGGAGUU |
| 588 | 132 | UUUAUUAAGAAGACAUGUUAA |
| 589 | 133 | UUGGAAUUGGUAUUUCAGUUG |
| 590 | 134 | AUCAAGUCUAUGUAUUUCUAU |
| 591 | 135 | UUCAUUAUCACAUGAUAAGGA |
| 592 | 136 | AACAAUGACUUUGUAAGUGGU |
| 593 | 137 | AUUGAGUAUGGUCAUAUUGUU |
| 594 | 138 | UACAGUUGUAUACAUGAUAUA |
| 595 | 139 | UACCAAGUCAGAGUACCCGAU |
| 596 | 140 | UAUAAGUCUAAUAAGAUCAUC |
| 597 | 141 | UGGUAUUUCAGUUGGUUGCUG |
| 598 | 142 | AAGCAGAACAAUAUUACUUGG |
| 599 | 143 | AAAUACACAAACACUGGAGUA |
| 600 | 144 | UGCAUUAUUACAAGGGACGUU |
| 601 | 145 | UUGUAAGUGGUUGAAUUAGGA |
| 602 | 146 | UACUUGGUGUAAGAUACAGUU |
| 603 | 147 | UUAAUUUGAUUUAGGUCUGUC |
| 604 | 148 | AAUAAGAUUAUAAAUACACAA |
| 605 | 149 | UUGGAUUCAUUUGUGAUACCA |
| 606 | 150 | UAAGCAUCUGCUUCAAAGUUA |
| 607 | 151 | AGACUUUAAACAUUCGACGCG |
| 608 | 152 | ACAUAUUGACCACUUACUCUG |
| 609 | 153 | UGACAGAGAAGUUUCCAUCCA |
| 610 | 154 | UAGGUCUGUCAGCUCCCAGUA |
| 611 | 155 | AUCUACAGUUGUAUACAUGAU |
| 612 | 156 | UAUGUAUUUCUAUAAUUAGAU |
| 613 | 157 | ACCACUAAGAACAAUAACUUU |
| 614 | 158 | UGUGAUGAAGCUGAAUGCCUA |
| 615 | 159 | UCAGAUACCCAUUUGCAUCUA |
| 616 | 160 | AUUAGCAUUGAUAAACUUUUU |
| 617 | 161 | UAACAGCUCCUAAUUCACUCU |
| 618 | 162 | AUAAUGACAACUACCACAUAU |
| 619 | 163 | UAUUAAUGACAACUACCA |
| 620 | 164 | UAUUUGAAUACUUUCCAAUAA |
| 621 | 165 | UAAAUGCAUGAGAAUGUGGAA |
| 622 | 166 | UAAUGUUUACAGUAACUCAAG |
| 623 | 167 | UACAGCACUACAGAAUAGAGA |

TABLE 4-continued

Results for ITFG1.
Score threshold: 70. Design: siRNA 21 nt.

| SEQ ID NO | siRNA_id | siRNA guide strand/ AS Sequence |
|---|---|---|
| 624 | 168 | UUGGUGUAAGAUACAGUUUGG |
| 625 | 169 | AAUGUGAUUGAAGAUUUGCAU |
| 626 | 170 | UGUAAGUGGUUGAAUUAGGAG |
| 627 | 171 | AUUACUGGUGUAAGAUACAG |
| 628 | 172 | UUUACAGUAACUCAAGUAUUA |
| 629 | 173 | UCGUAAAUGUCAAAGAAGGUG |
| 630 | 174 | UUGGUAUUUCAGUUGGUUGCU |
| 631 | 175 | ACACUUGUUAUCAAUGCACUG |
| 632 | 176 | UUCACAUACAUCAUCCCAUUU |
| 633 | 177 | AACUGGAAGGUACUAGUGGUG |
| 634 | 178 | UAGGAUCUAAUGUUUGAUUUU |
| 635 | 179 | UCUUUAGUAUGACCAGAGCGU |
| 636 | 180 | UUAUGUAAUAUUAAAGGCAAG |
| 637 | 181 | UACUGACAGAGAAGUUUCCAU |
| 638 | 182 | AUGACUUUGUAAGUGGUUGAA |
| 639 | 183 | AUUACAAGGGACGUUCUCCAG |
| 640 | 184 | UCUGUGCUAGGCACCAAGCUA |
| 641 | 185 | UACCCAUUUGCAUCUACAGUU |
| 642 | 186 | UGCAUCUACAGUUGUAUACAU |
| 643 | 187 | UCAUUCUUUGUAUAUCCUUUA |
| 644 | 188 | UUAGAUCACCAUUGAAAUCCA |
| 645 | 189 | UUGAGAAUAGAAAUGUGAUUG |
| 646 | 190 | UAUGUCAGAAGGACAUCCAUU |
| 647 | 191 | UAAGAACAAUAACUUUAACAA |
| 648 | 192 | UUGUGACAUAUUCAAACCAUA |
| 649 | 193 | UUUAGUAUGACCAGAGCGUCU |
| 650 | 194 | UUGUAUGGUAGUUUGGAGAGCU |
| 651 | 195 | UUGCAGUCCACUCUUGUUUUC |
| 652 | 196 | UAUUAGCAUUGAUAAACUUUU |
| 653 | 197 | UAGUCUCCAAUAUGAAGGGUA |
| 654 | 198 | UUUCAAACUGGAAGGUACUAG |
| 655 | 199 | AAUUAUAGACUUCUCCAAGUG |
| 656 | 200 | AUAAGCAUCUGCUUCAAAGUU |
| 657 | 201 | AAACUGGAAGGUACUAGUGGU |
| 658 | 202 | AUGACAACUACCACAUAUUGA |
| 659 | 203 | UGUAUUUCUAUAAUUAGAUGU |
| 660 | 204 | AAGUCUGCAAAUGCUGACUGU |
| 661 | 205 | UCUCUAUCAUCUGCUUUCUUU |
| 662 | 206 | ACAACUACCACAUAUUGACCA |
| 663 | 207 | UAUUCAAACCAUAUUUAUUUG |
| 664 | 208 | UUCGUAAAUGUCAAAGAAGGU |
| 665 | 209 | AUUGCUGAAAUCUUGUAGGAC |
| 666 | 210 | UUCGAGGGACAUUGUGAGGGU |
| 667 | 211 | AGUCAUUAGAACACAGACCAC |
| 668 | 212 | UAGACUUCUCCAAGUGUUUGA |
| 669 | 213 | UUAUUGCUGAAAUCUUGUAGG |
| 670 | 214 | ACUAAUCAAGUGAACAGCCAU |
| 671 | 215 | UUGAAGUCUGAAUGUAAAUUA |
| 672 | 216 | AUGAGAAUGUGGAAUUCGCAU |
| 673 | 217 | UGUAAAUUAUAGACUUCUCCA |
| 674 | 218 | UAUAGACUUCUCCAAGUGUUU |
| 675 | 219 | UUAGGAUCUAAUGUUUGAUUU |
| 676 | 220 | UCUUGUAGGACUGGAACCCAC |
| 677 | 221 | UGCUGACUGUCCAACCACCAU |
| 678 | 222 | UUAGAAUAAGAAGCAAGACCA |
| 679 | 223 | UGUUAGGAUCUAAUGUUUGAU |
| 680 | 224 | UGGUCAUAUUGUUAGGAUCUA |
| 681 | 225 | UUGAAUACUUUCCAAUAAUUA |
| 682 | 226 | UGAUUGCAGUCCACUCUUGUU |
| 683 | 227 | UUAAACAUUCGACGCGCCUCU |
| 684 | 228 | AUGUUUACAGUAACUCAAGUA |
| 685 | 229 | UUACUGUGCUACCAAGUCAGA |
| 686 | 230 | UUCUUCAUUAUCACAUGAUAA |
| 687 | 231 | UGAAUGUAAAUUAUAGACUUC |
| 688 | 232 | UAGCUGGGAAUUUGGAAUGAU |
| 689 | 233 | UAGGCAUCACAUGUCCAUUUG |
| 690 | 234 | UGAUAUAAGGUCCAGGUUGAU |
| 691 | 235 | UCUAUGUAUUUCUAUAAUUAG |
| 692 | 236 | UGCAACACAUUCCACAAAGGA |
| 693 | 237 | UUUAAACAUUCGACGCGCCUC |
| 694 | 238 | UUGAAGAUUUGCAUUCCCAGA |
| 695 | 239 | UGUGAUUCUUGAAAGAUACCU |
| 696 | 240 | GUAAAUUAUAGACUUCUCCAA |
| 697 | 241 | AAAUGCUGACUGUCCAACCAC |

TABLE 4-continued

Results for ITFG1.
Score threshold: 70. Design: siRNA 21 nt.

| SEQ ID NO | siRNA_id | siRNA guide strand/AS Sequence |
|---|---|---|
| 698 | 242 | UCUUGAAAGAUACCUUUACUU |
| 699 | 243 | UACUUUCCAAUAAUUACCAUG |
| 700 | 244 | AUUGAAGAUUUGCAUUCCCAG |
| 701 | 245 | UGCUGAAAUCUUGUAGGACUG |
| 702 | 246 | AUUCCCUCCUAAUAGUAUCUG |
| 703 | 247 | UGUAGUCUCCAAUAUGAAGGG |
| 704 | 248 | UGUUUCAACUAAUCAAGUGAA |
| 705 | 249 | UAUAAUUUGCAUCAUUAGAAU |
| 706 | 250 | AUUGUUAGGAUCUAAUGUUUG |
| 707 | 251 | AUAUCCUUUACUUAGCACUAC |
| 708 | 252 | UGUAUGGUAGUUGGAGAGCUA |
| 709 | 253 | AACAUGCUUAGAUACAAAGUA |
| 710 | 254 | AUGUUCUUCAUUAUCACAUGA |
| 711 | 255 | UACCCGAUCACUAUAUUGUAU |
| 712 | 256 | UGUUCUUCAUUAUCACAUGAU |
| 713 | 257 | UUAGCUGGGAAUUUGGAAUGA |
| 714 | 258 | UAAAUACACAAACACUGGAGU |
| 715 | 259 | AGGAAUUAGAUCACCAUUGAA |
| 716 | 260 | UUCCCUCCUAAUAGUAUCUGU |
| 717 | 261 | UUACUUGGUGUAAGAUACAGU |
| 718 | 262 | AAAGAUACCUUUACUUUGGGU |
| 719 | 263 | UUAGAUGUAUAAGUCUAAUAA |
| 720 | 264 | ACACAUUCCACAAAGGAACAA |
| 721 | 265 | UCUACAGUUGUAUACAUGAUA |
| 722 | 266 | UGUAUAUCCUUUACUUAGCAC |
| 723 | 267 | UUGUUAGGAUCUAAUGUUUGA |
| 724 | 268 | UCUGCAAAUGCUGACUGUCCA |
| 725 | 269 | UACCAACGUAGAGAUGGUCAA |
| 726 | 270 | UAAACCAAGCACGUUGUAUGG |
| 727 | 271 | AAGAAAUCAAAUGUUCUUCAU |
| 728 | 272 | UCACAUGAUAAGGAUAAGUUU |
| 729 | 273 | UGAAAUCUUGUAGGACUGGAA |
| 730 | 274 | UGUCAGAAGGACAUCCAUUUG |
| 731 | 275 | ACUUAGCACUACAAUGUCCAA |
| 732 | 276 | AACUUCGAGGGACAUUGUGAG |
| 733 | 277 | AUGGAAUGACAAUUAGCUGGG |
| 734 | 278 | AUAUUUAUUAAGAAGACAUGU |
| 735 | 279 | UACCAUGGGAUACAUCAUUUA |
| 736 | 280 | AUCUUCGUAAAUGUCAAAGAA |
| 737 | 281 | UCUUACUGUGCUACCAAGUCA |
| 738 | 282 | UCAUUAUCACAUGAUAAGGAU |
| 739 | 283 | UAAUUUGAUUUAGGUCUGUCA |
| 740 | 284 | AGUACAUGCAACACAUUCCAC |
| 741 | 285 | AUCAUUCUUUGUAUAUCCUUU |
| 742 | 286 | AAAUAUAUUUAAUCUCCCCU |
| 743 | 287 | CAAGUCUGUCUUACUGUGCUA |
| 744 | 288 | AAAGUCUGCAAAUGCUGACUG |
| 745 | 289 | AUGAUUGCAGUCCACUCUUGU |
| 746 | 290 | AAACCAAGCACGUUGUAUGGU |
| 747 | 291 | AUAAAUAAUAUUUAAUCUCCC |
| 748 | 292 | UUUGCAUCAUUAGAAUAAGAA |
| 749 | 293 | AACACAGACCACUAAGAACAA |
| 750 | 294 | ACAAUGACUUUGUAAGUGGUU |
| 751 | 295 | UUCUAUAAUUAGAUGUAUAAG |
| 752 | 296 | AUUUAUUAAGAAGACAUGUUA |
| 753 | 297 | AUUGAAAUCCAUAAUUAGUGG |
| 754 | 298 | AUUAUAGACUUCUCCAAGUGU |
| 755 | 299 | AAUGACAACUACCACAUAUUG |
| 756 | 300 | AAGUGGUUGAAUUAGGAGUUU |
| 757 | 301 | AUAGUACUGACAGAGAAGUUU |
| 758 | 302 | AAAGAAUAUUUCUUCAUGCCU |
| 759 | 303 | UCCAUCUCCAUCAAAGUCUGC |
| 760 | 304 | UGACAUAUUCAAACCAUAUUU |
| 761 | 305 | UAGCAGUAAGCAGAACAAUAU |
| 762 | 306 | UGACCACUUACUCUGUGCUAG |
| 763 | 307 | AUAAGGUCCAGGUUGAUUCAC |
| 764 | 308 | UAUAGGCAUCACAUGUCCAUU |
| 765 | 309 | UGUUUGAGAAUAGAAAUGUGA |
| 766 | 310 | AUAGACUUCUCCAAGUGUUUG |
| 767 | 311 | UGUCCAAGAUUCCAUCUUCGU |
| 768 | 312 | UUCUAUCAAGUCUAUGUAUUU |
| 769 | 313 | AGAAGACAUGUUAACAUGCUU |
| 770 | 314 | AUGUACAGCACUACAGAAUAG |
| 771 | 315 | UAGGCACCAAGCUAAGCACUU |

TABLE 4-continued

Results for ITFG1.
Score threshold: 70. Design: siRNA 21 nt.

| SEQ ID NO | siRNA_id | siRNA guide strand/ AS Sequence |
|---|---|---|
| 772 | 316 | UCAUUAGAACACAGACCACUA |
| 773 | 317 | UCAUUUAUAAAUAAUAUUUAA |
| 774 | 318 | AGAAUCUCCAUCAUAAUCCCC |
| 775 | 319 | UAAUUCUUGGAGAGUACUAUA |
| 776 | 320 | AUCUCAGUGAACUAUAAAGAA |
| 777 | 321 | AUCCUUUACUUAGCACUACAA |
| 778 | 322 | AUGUCCAUUUGCAUACUAGAA |
| 779 | 323 | UAAAUCUUUAUGUCAAUCACC |
| 780 | 324 | UCCAUCUUCGUAAAUGUCAAA |
| 781 | 325 | UUUAAGGCAAGUCUGUCUUAC |
| 782 | 326 | ACUAAGUAGAUGGUACUCUUU |
| 783 | 327 | AUGCUGACUGUCCAACCACCA |
| 784 | 328 | UCAACUAAUCAAGUGAACAGC |
| 785 | 329 | UAUUACAAGGGACGUUCUCCA |
| 786 | 330 | UGAAGGGUAAUUGGAAUUGGU |
| 787 | 331 | UGAUUCACUCCAAAGGGUGUU |
| 788 | 332 | AUUAAUUCUUGGAGAGUACUA |
| 789 | 333 | AUUUGGAAUGAUUGCAGUCCA |
| 790 | 334 | UUAACAUGCUUAGAUACAAAG |
| 791 | 335 | AUAAGGAAUAUUUAUUAAGAA |
| 792 | 336 | UAAUUUGCAUCAUUAGAAUAA |
| 793 | 337 | AGCAGAACAAUAUUACUUGGU |
| 794 | 338 | CUUAAUUUGAUUUAGGUCUGU |
| 795 | 339 | AAUAGAAAUGUGAUUGAAGAU |
| 796 | 340 | UAUGAGCAAGUAAAUCUUUAU |
| 797 | 341 | UUUGAGAAUCUCCAUCAUAAU |
| 798 | 342 | AGUUCAAACAAUGACUUUGUA |
| 799 | 343 | UAGUUGGAGAGCUAAAUGUGC |
| 800 | 344 | AUAGGGUGCAUUCUGGUCUGC |
| 801 | 345 | UUGUAGUCUCCAAUAUGAAGG |
| 802 | 346 | AUAAGAGCAAGACCAAGUCA |
| 803 | 347 | AUUAUGUAAUAUUAAAGGCAA |
| 804 | 348 | UUCUUGGAGAGUACUAUAAUU |
| 805 | 349 | UACACUUGUUAUCAAUGCACU |
| 806 | 350 | AAGAAGACAUGUUAACAUGCU |
| 807 | 351 | UUACAAGGGACGUUCUCCAGU |
| 808 | 352 | CAUCAUUAGAAUAAGAAGCAA |
| 809 | 353 | UUCAAUAAGGAAUAUUUAUUA |
| 810 | 354 | UACAUGAUAUAAGGUCCAGGU |
| 811 | 355 | AUUAGAACACAGACCACUAAG |
| 812 | 356 | AUUAUUACAAGGGACGUUCUC |
| 813 | 357 | UAGUGGUCAAUGCUGGAUGCC |
| 814 | 358 | AUCCAUAUUGUAGUCUCCAAU |
| 815 | 359 | AUAUGAGCAAGUAAAUCUUUA |
| 816 | 360 | UUUGCAUCUACAGUUGUAUAC |
| 817 | 361 | AGUAUGACCAGAGCGUCUGGA |
| 818 | 362 | UACAAGGGACGUUCUCCAGUA |
| 819 | 363 | UUACGAGGACAGUCAUUAGAA |
| 820 | 364 | AUUAAGAAGACAUGUUAACAU |
| 821 | 365 | UGAAGUCUGAAUGUAAAUUAU |
| 822 | 366 | ACACAGACCACUAAGAACAAU |
| 823 | 367 | CACUACAGAAUAGAGAACCCA |
| 824 | 368 | UUCAAACCAUAUUUAUUUGAA |
| 825 | 369 | UCAAAUGUUCUUCAUUAUCAC |
| 826 | 370 | UCAGGAAUAAAUCUGCUGUAA |
| 827 | 371 | UAUAAGGUCCAGGUUGAUUCA |
| 828 | 372 | ACAAACACUGGAGUACAUGCA |
| 829 | 373 | UUUAUAAAUAAUAUUUAAUCU |
| 830 | 374 | ACAGAGGUUAAACAAGAGCCA |
| 831 | 375 | UGUAGGACUGGAACCCACUGC |
| 832 | 376 | UGUCCAACCACCAUCAUAUUU |
| 833 | 377 | CAGUAGACUUUAAACAUUCGA |
| 834 | 378 | ACAUGCAACACAUUCCACAAA |
| 835 | 379 | UCAGAAGGACAUCCAUUUGAG |
| 836 | 380 | UCUAUCAUCUGCUUUCUUUUC |
| 837 | 381 | AUCAAUGCACUGUGAUUCUUG |
| 838 | 382 | UUGCAUCAUUAGAAUAAGAAG |
| 839 | 383 | UCAAAGUCUGCAAAUGCUGAC |
| 840 | 384 | AGUCCAUUGAGUAUGGUCAU |
| 841 | 385 | UACCACAUAUUGACCACUUAC |
| 842 | 386 | AGUAACUCAAGUAUUAGCCCC |
| 843 | 387 | UAACAUGCUUAGAUACAAAGU |
| 844 | 388 | UCACAUACAUCAUCCCAUUUA |
| 845 | 389 | AUCAUUUAUAAAUAAUAUUUA |

TABLE 4-continued

Results for ITFG1.
Score threshold: 70. Design: siRNA 21 nt.

| SEQ ID NO | siRNA_id | siRNA guide strand/ AS Sequence |
|---|---|---|
| 846 | 390 | CUUGUGACAUAUUCAAACCAU |
| 847 | 391 | UGAUUGAAGAUUUGCAUUCCC |
| 848 | 392 | ACUUGUUAUCAAUGCACUGUG |
| 849 | 393 | AGGCAAGUCACAUAGCAUCAA |
| 850 | 394 | UUGAUUCACUCCAAAGGGUGU |
| 851 | 395 | AAUGUGAAGUUCACAAUACAA |
| 852 | 396 | AGGACAGUCAUUAGAACACAG |
| 853 | 397 | UGUUCUUUAGUAUGACCAGAG |
| 854 | 398 | UAUUGAGUAUGGUCAUAUUGU |
| 855 | 399 | GUAGUCUCCAAUAUGAAGGGU |
| 856 | 400 | AUGUAUUUCUAUAAUUAGAUG |
| 857 | 401 | UACUCUGUGCUAGGCACCAAG |
| 858 | 402 | UGUUAACAUGCUUAGAUACAA |
| 859 | 403 | AUAAAUGCAUGAGAAUGUGGA |
| 860 | 404 | AUUUCAAACUGGAAGGUACUA |
| 861 | 405 | UCCAAGAUUCCAUCUUCGUAA |
| 862 | 406 | UCCUUUACUUAGCACUACAAU |
| 863 | 407 | AAUACCAACGUAGAGAUGGUC |
| 864 | 408 | ACAUGAUAUAAGGUCCAGGUU |
| 865 | 409 | AUCUUUAUGUCAAUCACCAAA |
| 866 | 410 | UGAAAGAUACCUUUACUUUGG |
| 867 | 411 | AAGGCAAGUCUGUCUUACUGU |
| 868 | 412 | UGGAAUUGGUAUUUCAGUUGG |
| 869 | 413 | UAUAAUAAUAUUUAAUCUCC |
| 870 | 414 | AUAAAUUCCUCCUAAUAGUA |
| 871 | 415 | AUAAUUUGCAUCAUUAGAAUA |
| 872 | 416 | ACUUGUAGUGGUCAAUGCUGG |
| 873 | 417 | AUCUGCUUCAAAGUUAUUUUU |
| 874 | 418 | UAAGAAGACAUGUUAACAUGC |
| 875 | 419 | AAGCACUUCACAUACAUCAUC |
| 876 | 420 | UACAUCAUUUAUAAAUAAUAU |
| 877 | 421 | AUUGACCACUUACUCUGUGCU |
| 878 | 422 | UUCAAUGUCGUCAGGAAUAAA |
| 879 | 423 | AUACAUGAUAUAAGGUCCAGG |
| 880 | 424 | AAAUGUUCUUCAUUAUCACAU |
| 881 | 425 | AUUCAAACCAUAUUUAUUUGA |
| 882 | 426 | CAUUAGAACACAGACCACUAA |
| 883 | 427 | UGCUGGUUGCUUCCAGAUGUG |
| 884 | 428 | AUUGGAAUUGGUAUUUCAGUU |
| 885 | 429 | UAAUAUUAAAGGCAAGUCACA |
| 886 | 430 | CACUUCACAUACAUCAUCCCA |
| 887 | 431 | UAUCCUUUACUUAGCACUACA |
| 888 | 432 | AAUACUUUCCAAUAAUUACCA |
| 889 | 433 | UCCCUCCUAAUAGUAUCUGUG |
| 890 | 434 | AUGUGAUUGAAGAUUUGCAUU |
| 891 | 435 | AGAACAAUAUUACUUGGUGUA |
| 892 | 436 | AAUAUUUAUUAAGAAGACAUG |
| 893 | 437 | UCUAUCAAGUCUAUGUAUUUC |
| 894 | 438 | AAUAUUAAAGGCAAGUCACAU |
| 895 | 439 | UAUUUCAGUUGGUUGCUGUUC |
| 896 | 440 | GUAUGGAAUGACAAUUAGCUG |
| 897 | 441 | UCACAGCUUGCAUUAUUACAA |
| 898 | 442 | AAGUCUGUCUUACUGUGCUAC |
| 899 | 443 | AGUAUGGUCAUAUUGUUAGGA |
| 900 | 444 | UCAAUAAGGAAUAUUUAUUAA |
| 901 | 445 | AAACAAUGACUUUGUAAGUGG |
| 902 | 446 | UGGAUUCAUUUGUGAUACCAA |
| 903 | 447 | UAUUAAAGGCAAGUCACAUAG |
| 904 | 448 | UGGGAAUUUGGAAUGAUUGCA |
| 905 | 449 | AAUCUUGUAGGACUGGAACCC |
| 906 | 450 | AUCUCCAUCAAAGUCUGCAAA |
| 907 | 451 | UUAGAACACAGACCACUAAGA |
| 908 | 452 | UCACUAAGUAGAUGGUACUCU |
| 909 | 453 | UUUCUAUAAUUAGAUGUAUAA |
| 910 | 454 | UGCAUUGAAGUCUGAAUGUAA |
| 911 | 455 | UUUGCGCUCCGACCUAAACCA |
| 912 | 456 | UGAUUUAGGUCUGUCAGCUCC |
| 913 | 457 | AACCGGUGGGCUUCUUGUCGU |
| 914 | 458 | UGAAGAUUUGCAUUCCCAGAU |
| 915 | 459 | UUAUUUGAAUACUUUCCAAUA |
| 916 | 460 | UCCCAGUAGACUUUAAACAUU |
| 917 | 461 | UCAGUCAGAUCAAUAAAUGCA |
| 918 | 462 | CAUCCAUUUGAGAAUCUCCAU |
| 919 | 463 | UAGAAAUGUGAUUGAAGAUUU |

TABLE 4-continued

Results for ITFG1.
Score threshold: 70. Design: siRNA 21 nt.

| SEQ ID NO | siRNA_id | siRNA guide strand/ AS Sequence |
|---|---|---|
| 920 | 464 | ACAGCUCCUAAUUCACUCUUG |
| 921 | 465 | UUAGGUCUGUCAGCUCCCAGU |
| 922 | 466 | AAGACAUGUUAACAUGCUUAG |
| 923 | 467 | AUACCCAUUUGCAUCUACAGU |
| 924 | 468 | AAAUCUUUAUGUCAAUCACCA |
| 925 | 469 | CAGAGGUUAAACAAGAGCCAA |
| 926 | 470 | AUCAGGAAUUAGAUCACCAUU |
| 927 | 471 | UCCCAUUUAAUGUUUACAGUA |
| 928 | 472 | AGGCAAGUCUGUCUUACUGUG |
| 929 | 473 | UCUCAGUGAACUAUAAAGAAA |
| 930 | 474 | UAUUGACCACUUACUCUGUGC |
| 931 | 475 | AUGUAAAUUAUAGACUUCUCC |
| 932 | 476 | UCAGAUCAAUAAAUGCAUGAG |
| 933 | 477 | UGAGAAUGUGGAAUUCGCAUU |
| 934 | 478 | UUGCAUCUACAGUUGUAUACA |
| 935 | 479 | CUUAUUGCUGAAAUCUUGUAG |
| 936 | 480 | ACUUGGUGUAAGAUACAGUUU |
| 937 | 481 | AUAUUGUAGUCUCCAAUAUGA |
| 938 | 482 | ACAUCCAUUUGAGAAUCUCCA |
| 939 | 483 | UUAUCAAUGCACUGUGAUUCU |
| 940 | 484 | AUUACCAUGGGAUACAUCAUU |
| 941 | 485 | ACUUCACAUACAUCAUCCCAU |
| 942 | 486 | AUCAAAGUCUGCAAAUGCUGA |
| 943 | 487 | AUCCUUAAUUUGAUUUAGGUC |
| 944 | 488 | UGAAGCUGAAUGCCUAAUGAC |
| 945 | 489 | AGCAAGACCAAGUCAAGUGGA |
| 946 | 490 | AUUGCAGUCCACUCUUGUUUU |
| 947 | 491 | CAAACAAUGACUUUGUAAGUG |
| 948 | 492 | UCUAAUAAGAUCAUCUAAAAU |
| 949 | 493 | AUAACAGCUCCUAAUUCACUC |
| 950 | 494 | UAGGAAUAUUUAUUAAGAAG |
| 951 | 495 | AAGGGUGUUAUCUUACGAGGA |
| 952 | 496 | UAAUGACAACUACCACAUAUU |
| 953 | 497 | UAUUACUUGGUGUAAGAUACA |
| 954 | 498 | AUCAUUAGAAUAAGAAGCAAG |
| 955 | 499 | CAAUAUAGUACUGACAGAGAA |
| 956 | 500 | AUUGUAGUCUCCAAUAUGAAG |
| 957 | 501 | UGACAACUACCACAUAUUGAC |
| 958 | 502 | ACUACAAUGUCCAAGAUUCCA |
| 959 | 503 | UCAGGAAUUAGAUCACCAUUG |
| 960 | 504 | ACCGGUGGGCUUCUUGUCGUU |
| 961 | 505 | AUGUCCAAGAUUCCAUCUUCG |
| 962 | 506 | AAUAAAUGCAUGAGAAUGUGG |
| 963 | 507 | AAGCAAGACCAAGUCAAGUGG |
| 964 | 508 | UCUUCGUAAAUGUCAAAGAAG |
| 965 | 509 | UUACCAUGGGAUACAUCAUUU |
| 966 | 510 | UUACAGAGGUUAAACAAGAGC |
| 967 | 511 | UUGCUGAAAUCUUGUAGGACU |
| 968 | 512 | UUGGAAUGAUUGCAGUCCACU |
| 969 | 513 | UAUGAAGGGUAAUUGGAAUUG |
| 970 | 514 | AUGAGCAAGUAAAUCUUUAUG |
| 971 | 515 | UUUGUAAGUGGUUGAAUUAGG |
| 972 | 516 | AACUACCACAUAUUGACCACU |
| 973 | 517 | UCAAACAAUGACUUUGUAAGU |
| 974 | 518 | AAUUCUUGGAGAGUACUAUAA |
| 975 | 519 | CUUACUGUGCUACCAAGUCAG |
| 976 | 520 | ACAAUUAGCUGGGAAUUUGGA |
| 977 | 521 | UGGAGUACAUGCAACACAUUC |
| 978 | 522 | AGAAAUGUGAUUGAAGAUUUG |
| 979 | 523 | UGCAUUCCCAGAUGCUGCCUA |
| 980 | 524 | UAAAUUCCUCCUAAUAGUAU |
| 981 | 525 | AUUCUUUGUAUAUCCUUUACU |
| 982 | 526 | UUCCAUAAUUACCAUGGGAU |
| 983 | 527 | UUCUUGAAAGAUACCUUUACU |
| 984 | 528 | UGAGCAAGUAAAUCUUUAUGU |
| 985 | 529 | CUGAAUGUAAAUUAUAGACUU |
| 986 | 530 | UGUGAGGGUAUGGAAUGACAA |
| 987 | 531 | AAUGUUCUUCAUUAUCACAUG |
| 988 | 532 | ACAGACACCGAUGAGAGCUAU |
| 989 | 533 | CCAACUUCGAGGGACAUUGUG |
| 990 | 534 | UAGUACUGACAGAGAAGUUUC |
| 991 | 535 | UUCACAGCUUGCAUUAUUACA |
| 992 | 536 | CAUAUUGACCACUUACUCUGU |
| 993 | 537 | AGGGACUACACUUGUUAUCAA |

TABLE 4-continued

Results for ITFG1.
Score threshold: 70. Design: siRNA 21 nt.

| SEQ ID NO | siRNA_id | siRNA guide strand/ AS Sequence |
|---|---|---|
| 994 | 538 | UUAUCACAUGAUAAGGAUAAG |
| 995 | 539 | AAUUACCAUGGGAUACAUCAU |
| 996 | 540 | ACUACACUUGUUAUCAAUGCA |
| 997 | 541 | UACAAUGUCCAAGAUUCCAUC |
| 998 | 542 | AUUUGCAUUGAAGUCUGAAUG |
| 999 | 543 | AUGAAGGGUAAUUGGAAUUGG |
| 1000 | 544 | ACUACAGAAUAGAGAACCCAA |
| 1001 | 545 | GAGAGCUAUAGCAGUAAGCAG |
| 1002 | 546 | AGAAUGUGGAAUUCGCAUUUU |
| 1003 | 547 | UCCAGGUUGAUUCACUCCAAA |
| 1004 | 548 | UUUCAAGAAAUCAAAUGUUCU |
| 1005 | 549 | ACCUAAACCAAGCACGUUGUA |
| 1006 | 550 | AAUAUAGUACUGACAGAGAAG |
| 1007 | 551 | GAUCUCACUAAGUAGAUGGUA |
| 1008 | 552 | UGUACAGCACUACAGAAUAGA |
| 1009 | 553 | UGUAAUAUUAAAGGCAAGUCA |
| 1010 | 554 | UUCCUUUCAAGAAAUCAAAUG |
| 1011 | 555 | AUCCAUUUGAGAAUCUCCAUC |
| 1012 | 556 | UAUCACAUGAUAAGGAUAAGU |
| 1013 | 557 | CAAUGCACUGUGAUUCUUGAA |
| 1014 | 558 | UGGAGAGCUAAAUGUGCGGAU |
| 1015 | 559 | UAAGAUUAUAAAUACACAAAC |
| 1016 | 560 | AUAAGAUUAUAAAUACACAAA |
| 1017 | 561 | UCUUGGAGAGUACUAUAAUUU |
| 1018 | 562 | AACAAUAUUACUUGGUGUAAG |
| 1019 | 563 | UCAAGAAAUCAAAUGUUCUUC |
| 1020 | 564 | UGUCGUCAGGAAUAAAUCUGC |
| 1021 | 565 | GAGUACAUGCAACACAUUCCA |
| 1022 | 566 | UAUGACCAGAGCGUCUGGAUA |
| 1023 | 567 | UCCAACCACCAUCAUAUUUUG |
| 1024 | 568 | CUGCAAAUGCUGACUGUCCAA |
| 1025 | 569 | UCCGACCUAAACCAAGCACGU |
| 1026 | 570 | UGUCAGCUCCCAGUAGACUUU |
| 1027 | 571 | AUUCUAUCAAGUCUAUGUAUU |
| 1028 | 572 | CUUAGCACUACAAUGUCCAAG |
| 1029 | 573 | UGAGAAUAGAAAUGUGAUUGA |
| 1030 | 574 | AAGCACGUUGUAUGGUAGUUG |
| 1031 | 575 | UAGGGUGCAUUCUGGUCUGCC |
| 1032 | 576 | UCAAUGCACUGUGAUUCUUGA |
| 1033 | 577 | UCCAAGUGUUUGAGAAUAGAA |
| 1034 | 578 | UCCAAUAUGAAGGGUAAUUGG |
| 1035 | 579 | CUUUCCAAUAAUUACCAUGGG |
| 1036 | 580 | UUAAUAUGAGCAAGUAAAUCU |
| 1037 | 581 | UUUCCUUUCAAGAAAUCAAAU |
| 1038 | 582 | UGACUUUGUAAGUGGUUGAAU |
| 1039 | 583 | GUAAGCAGAACAAUAUUACUU |
| 1040 | 584 | AUUCCAUCUUCGUAAAUGUCA |
| 1041 | 585 | UCUUACGAGGACAGUCAUUAG |
| 1042 | 586 | AAAUGUGAUUGAAGAUUUGCA |
| 1043 | 587 | ACAUAUUCAAACCAUAUUUAU |
| 1044 | 588 | UGUGACAUAUUCAAACCAUAU |
| 1045 | 589 | UUUGAAUACUUUCCAAUAAUU |
| 1046 | 590 | AAUGCCUAAUGACUCCGUGAU |
| 1047 | 591 | AUUUGAUUUAGGUCUGUCAGC |
| 1048 | 592 | AUAGGCAUCACAUGUCCAUUU |
| 1049 | 593 | UCAUGAUGCAAAUAAGAUUAU |
| 1050 | 594 | AGUUGGUUGCUGUUCAUCCAC |
| 1051 | 595 | AAGUCUAUGUAUUUCUAUAAU |
| 1052 | 596 | UGCACUGUGAUUCUUGAAAGA |
| 1053 | 597 | UGACAAUUAGCUGGGAAUUUG |
| 1054 | 598 | UGUCCAUUUGCAUACUAGAAA |
| 1055 | 599 | AUAGAAAUGUGAUUGAAGAUU |
| 1056 | 600 | UCCAACUUCGAGGGACAUUGU |
| 1057 | 601 | UUGAGAAUCUCCAUCAUAAUC |
| 1058 | 602 | GAUCACUAUAUUGUAUGCCAU |
| 1059 | 603 | UUCAUCCCAGAUCUCACUAAG |
| 1060 | 604 | UGAGUAUGGUCAUAUUGUUAG |
| 1061 | 605 | UGUGCUACCAAGUCAGAGUAC |
| 1062 | 606 | CAAACUGGAAGGUACUAGUGG |
| 1063 | 607 | ACACAAACACUGGAGUACAUG |
| 1064 | 608 | AUAUCAGGAAUUAGAUCACCA |
| 1065 | 609 | AAUGUUUACAGUAACUCAAGU |
| 1066 | 610 | UGUUUACAGUAACUCAAGUAU |
| 1067 | 611 | ACAUGCUUAGAUACAAAGUAA |

TABLE 4-continued

Results for ITFG1.
Score threshold: 70. Design: siRNA 21 nt.

| SEQ ID NO | siRNA_id | siRNA guide strand/ AS Sequence |
|---|---|---|
| 1068 | 612 | AUCACCAUUGAAAUCCAUAAU |
| 1069 | 613 | UAUUUCUUCAUGCCUGAAAAU |
| 1070 | 614 | UCAAGUCUAUGUAUUUCUAUA |
| 1071 | 615 | CAGAACAAUAUUACUUGGUGU |
| 1072 | 616 | UAGUUAAUAUGAGCAAGUAAA |
| 1073 | 617 | CUGAAAUCUUGUAGGACUGGA |
| 1074 | 618 | AAACAUUCGACGCGCCUCUUC |
| 1075 | 619 | UUCCUGCUCAUUUAAUUAUUU |
| 1076 | 620 | UGGGAAGAUAUGUCAGAAGGA |
| 1077 | 621 | UUUCAAUAAGGAAUAUUUAUU |
| 1078 | 622 | AUGACUCCGUGAUAUAUUCAC |
| 1079 | 623 | CAAACACUGGAGUACAUGCAA |
| 1080 | 624 | AAUGACUUUGUAAGUGGUUGA |
| 1081 | 625 | AAUGUCGUCAGGAAUAAAUCU |
| 1082 | 626 | UUCCAUUAUGUAAUAUUAAAG |
| 1083 | 627 | UUUGCAUUCCCAGAUGCUGCC |
| 1084 | 628 | UCAUAUUGUUAGGAUCUAAUG |
| 1085 | 629 | AAGUGUUUGAGAAUAGAAAUG |
| 1086 | 630 | AAGAUAACAGCUCCUAAUUCA |
| 1087 | 631 | AUUCUUGAAAGAUACCUUUAC |
| 1088 | 632 | AGUUUAAGGCAAGUCUGUCUU |
| 1089 | 633 | ACUACCACAUAUUGACCACUU |
| 1090 | 634 | AGGAGUUUAAGGCAAGUCUGU |
| 1091 | 635 | UUCAGUUGGUUGCUGUUCAUC |
| 1092 | 636 | AUUUAAUGUUUACAGUAACUC |
| 1093 | 637 | UCACAUGUCCAUUUGCAUACU |
| 1094 | 638 | UGCCCUUAUUGCUGAAAUCUU |
| 1095 | 639 | UGUAUAAGUCUAAUAAGAUCA |
| 1096 | 640 | UACAGAGGUUUAAACAAGAGCC |
| 1097 | 641 | AAUUAGAUGUAUAAGUCUAAU |
| 1098 | 642 | GAGAAUAGAAAUGUGAUUGAA |
| 1099 | 643 | UGUCCAUCUCCAUCAAAGUCU |
| 1100 | 644 | UUCAAACAAUGACUUUGUAAG |
| 1101 | 645 | AAUGUAAAUUAUAGACUUCUC |
| 1102 | 646 | GUAUACAUGAUAUAAGGUCCA |
| 1103 | 647 | AGACUUCUCCAAGUGUUUGAG |
| 1104 | 648 | UACAGAAUAGAGAACCCAAAU |
| 1105 | 649 | CUUGUAGUGGUCAAUGCUGGA |
| 1106 | 650 | UUUGUAUAUCCUUUACUUAGC |
| 1107 | 651 | UUCUCCAAGUGUUUGAGAAUA |
| 1108 | 652 | UCAAACCAUAUUUAUUUGAAU |
| 1109 | 653 | AAUGACUCCGUGAUAUAUUCA |
| 1110 | 654 | AUUCUUGGAGAGUACUAUAAU |
| 1111 | 655 | CAUCAAAGUCUGCAAAUGCUG |
| 1112 | 656 | AGACAUGUUAACAUGCUUAGA |
| 1113 | 657 | UGUGAUUGAAGAUUUGCAUUC |
| 1114 | 658 | AAGAUACCUUUACUUUGGGUU |
| 1115 | 659 | AGAAUAUUUCUUCAUGCCUGA |
| 1116 | 660 | AUUUGCAUCUACAGUUGUAUA |
| 1117 | 661 | UCCAUUUGAGAAUCUCCAUCA |
| 1118 | 662 | UCCAAAGAAUAUUUCUUCAUG |
| 1119 | 663 | AAUAAUUACCAUGGGAUACAU |
| 1120 | 664 | UGGAAAUGUGAAGUUCACAAU |
| 1121 | 665 | ACACCGAUGAGAGCUAUAGCA |
| 1122 | 666 | ACUGGAGUACAUGCAACACAU |
| 1123 | 667 | AGGUCUGUCAGCUCCCAGUAG |
| 1124 | 668 | UUAGGAGUUUAAGGCAAGUCU |
| 1125 | 669 | AUAUAGUACUGACAGAGAAGU |
| 1126 | 670 | CCAUUUGAGAAUCUCCAUCAU |
| 1127 | 671 | UGUCUUACUGUGCUACCAAGU |
| 1128 | 672 | ACAGCUUGCAUUAUUACAAGG |
| 1129 | 673 | AGUAGACUUUAAACAUUCGAC |
| 1130 | 674 | UACAGUAACUCAAGUAUUAGC |
| 1131 | 675 | UGAGAGCUAUAGCAGUAAGCA |
| 1132 | 676 | ACCAUUGAAAUCCAUAAUUAG |
| 1133 | 677 | AGCUUGCAUUAUUACAAGGGA |
| 1134 | 678 | CAUAUUUCAAACUGGAAGGUA |
| 1135 | 679 | AACCAAGCACGUUGUAUGGUA |
| 1136 | 680 | UCUGAAUGUAAAUUAUAGACU |
| 1137 | 681 | ACCAUAUUUAUUUGAAUACUU |
| 1138 | 682 | CUUGUUAUCAAUGCACUGUGA |
| 1139 | 683 | AAAUCAAAUGUUCUUCAUUAU |
| 1140 | 684 | UAUGGUCAUAUUGUUAGGAUC |
| 1141 | 685 | AUCUUCAGUCAGAUCAAUAAA |

TABLE 4-continued

Results for ITFG1.
Score threshold: 70. Design: siRNA 21 nt.

| SEQ ID NO | siRNA_id | siRNA guide strand/ AS Sequence |
|---|---|---|
| 1142 | 686 | UAUGGUAGUUGGAGAGCUAAA |
| 1143 | 687 | UCCUUAAUUUGAUUUAGGUCU |
| 1144 | 688 | AUCCCAGAUCUCACUAAGUAG |
| 1145 | 689 | AAUAAGAAGCAAGACCAAGUC |
| 1146 | 690 | AAACCGGUGGGCUUCUUGUCG |
| 1147 | 691 | AGAUCUCACUAAGUAGAUGGU |
| 1148 | 692 | AUUUCUAUAAUUAGAUGUAUA |
| 1149 | 693 | UGGAAUGAUUGCAGUCCACUC |
| 1150 | 694 | UUCAGUCAGAUCAAUAAAUGC |
| 1151 | 695 | CACAUGUCCAUUUGCAUACUA |
| 1152 | 696 | GUCAGGAAUAAAUCUGCUGUA |
| 1153 | 697 | ACCCAUUUGCAUCUACAGUUG |
| 1154 | 698 | AGGAUCUAAUGUUUGAUUUUG |
| 1155 | 699 | AUAUUCAAACCAUAUUUAUUU |
| 1156 | 700 | AGGUUGAUUCACUCCAAAGGG |
| 1157 | 701 | GAAUGAUUGCAGUCCACUCUU |
| 1158 | 702 | UCGACGCGCCUCUUCACAGCU |
| 1159 | 703 | AUGACAAUUAGCUGGGAAUUU |
| 1160 | 704 | AGAAUAAGAAGCAAGACCAAG |
| 1161 | 705 | AGCUAAGCACUUCACAUACAU |
| 1162 | 706 | UCCAUUUGCAUACUAGAAAAU |
| 1163 | 707 | CACAUAUUGACCACUUACUCU |
| 1164 | 708 | AUAUUUAUUUGAAUACUUUCC |
| 1165 | 709 | AAUUGGUAUUUCAGUUGGUUG |
| 1166 | 710 | AGCACUACAAUGUCCAAGAUU |
| 1167 | 711 | AUGCCUAAUGACUCCGUGAUA |
| 1168 | 712 | UCAUCAUGAUGCAAAUAAGAU |
| 1169 | 713 | ACCUGCUGUGAUGAAGCUGAA |
| 1170 | 714 | AAACACUGGAGUACAUGCAAC |
| 1171 | 715 | UGCAUGAGAAUGUGGAAUUCG |
| 1172 | 716 | GUCCAAGAUUCCAUCUUCGUA |
| 1173 | 717 | CUACCACAUAUUGACCACUUA |
| 1174 | 718 | UCCAUCAUGAUGCAAAUA |
| 1175 | 719 | CAAUGUCCAAGAUUCCAUCUU |
| 1176 | 720 | UUAUAAGAAGACAUGUUAAC |
| 1177 | 721 | AGAAGGACAUCCAUUUGAGAA |
| 1178 | 722 | UCAGAGUACCCGAUCACUAUA |

TABLE 4-continued

Results for ITFG1.
Score threshold: 70. Design: siRNA 21 nt.

| SEQ ID NO | siRNA_id | siRNA guide strand/ AS Sequence |
|---|---|---|
| 1179 | 723 | AAUACACAAACACUGGAGUAC |
| 1180 | 724 | CUGAAUGCCUAAUGACUCCGU |
| 1181 | 725 | AUGUGAAGUUCACAAUACAAA |
| 1182 | 726 | AGCAAGUAAAUCUUUAUGUCA |
| 1183 | 727 | AAUUGGAAUUGGUAUUUCAGU |
| 1184 | 728 | AAUAUUACUUGGUGUAAGAUA |
| 1185 | 729 | CUUGGUGUAAGAUACAGUUUG |
| 1186 | 730 | GUGAUUCUUGAAAGAUACCUU |
| 1187 | 731 | UCACCAUUGAAAUCCAUAAUU |
| 1188 | 732 | UGUAGUGGUCAAUGCUGGAUG |
| 1189 | 733 | UCUUCAUUAUCACAUGAUAAG |
| 1190 | 734 | AAGUUCAAACAAUGACUUUGU |
| 1191 | 735 | UAUUUCAAACUGGAAGGUACU |
| 1192 | 736 | AAGUCUGAAUGUAAAUUAUAG |
| 1193 | 737 | AAUGUCCAAGAUUCCAUCUUC |
| 1194 | 738 | UGUUAUCUUACGAGGACAGUC |
| 1195 | 739 | GUGUUUGAGAAUAGAAAUGUG |
| 1196 | 740 | AGACCUUGUGACAUAUUCAAA |
| 1197 | 741 | AGAGCUAUAGCAGUAAGCAGA |
| 1198 | 742 | AAGGGUAAUUGGAAUUGGUAU |
| 1199 | 743 | UCCUGCUCAUUUAAUUAUUUU |
| 1200 | 744 | CUGGAGUACAUGCAACACAUU |
| 1201 | 745 | ACACAGACACCGAUGAGAGCU |
| 1202 | 746 | AUCAUGAUGCAAAUAAGAUUA |
| 1203 | 747 | AUUUGAAUACUUUCCAAUAAU |
| 1204 | 748 | AGAUUAUAAAUACACAAACAC |
| 1205 | 749 | GUAGUUGGAGAGCUAAAUGUG |
| 1206 | 750 | AGUCAGAUCAAUAAAUGCAUG |
| 1207 | 751 | UUUCAACUAAUCAAGUGAACA |
| 1208 | 752 | ACUUCGAGGGACAUUGUGAGG |
| 1209 | 753 | UUAUUACAAGGACGUUCUCC |
| 1210 | 754 | UGGUUGCUGUUCAUCCACAAA |
| 1211 | 755 | ACAUGUCCAUUUGCAUACUAG |
| 1212 | 756 | ACAGUUGUAUACAUGAUAUAA |
| 1213 | 757 | UGCUGCCUACAGCAGUUUCCU |
| 1214 | 758 | AUUAGAUGUAUAAGUCUAAUA |
| 1215 | 759 | UUCGACGCGCCUCUUCACAGC |

TABLE 4-continued

Results for ITFG1.
Score threshold: 70. Design: siRNA 21 nt.

| SEQ ID NO | siRNA_id | siRNA guide strand/ AS Sequence |
|---|---|---|
| 1216 | 760 | AAAUGCAUGAGAAUGUGGAAU |
| 1217 | 761 | UCUAUAAUUAGAUGUAUAAGU |
| 1218 | 762 | GACAGAGAAGUUUCCAUCCAA |
| 1219 | 763 | UACAGCAGUUUCCUUUCAAGA |
| 1220 | 764 | CUAUUGAGUAUGGUCAUAUUG |
| 1221 | 765 | GUAUAAGUCUAAUAAGAUCAU |
| 1222 | 766 | CAGUCAUUAGAACACAGACCA |
| 1223 | 767 | AUUCAAUGUCGUCAGGAAUAA |
| 1224 | 768 | AUGAUAUAAGGUCCAGGUUGA |
| 1225 | 769 | AUUAUCACAUGAUAAGGAUAA |
| 1226 | 770 | GUGUUCUUUAGUAUGACCAGA |
| 1227 | 771 | CAGAGUGUGCCCUUAUUGCUG |
| 1228 | 772 | AAGCUAAGCACUUCACAUACA |
| 1229 | 773 | CUUUAGUAUGACCAGAGCGUC |
| 1230 | 774 | UACGAGGACAGUCAUUAGAAC |
| 1231 | 775 | AUGUAUAAGUCUAAUAAGAUC |
| 1232 | 776 | CAUAUUGUUAGGAUCUAAUGU |
| 1233 | 777 | AUGUCAGAAGGACAUCCAUUU |
| 1234 | 778 | UGUGCUAGGCACCAAGCUAAG |
| 1235 | 779 | AUUUGCAUCAUUAGAAUAAGA |
| 1236 | 780 | CAAAGGGUGUUAUCUUACGAG |
| 1237 | 781 | AGCAGUAAGCAGAACAAUAUU |
| 1238 | 782 | AGAACAAUAACUUUAACAAAA |
| 1239 | 783 | CAUUUGAGAAUCUCCAUCAUA |
| 1240 | 784 | AUGCACUGUGAUUCUUGAAAG |
| 1241 | 785 | ACACUGGAGUACAUGCAACAC |
| 1242 | 786 | CCUUAUUGCUGAAAUCUUGUA |
| 1243 | 787 | AUGACCAGAGCGUCUGGAUAG |
| 1244 | 788 | AGGCCUGCUGGUUGCUUCCAG |
| 1245 | 789 | AGGUUUACAGAGGUUAAACAA |
| 1246 | 790 | AAAUUAUAGACUUCUCCAAGU |
| 1247 | 791 | AGAUGCUGCCUACAGCAGUUU |
| 1248 | 792 | UGGUUGGAUUCAUUUGUGAUA |
| 1249 | 793 | CAUGAGAAUGUGGAAUUCGCA |
| 1250 | 794 | GUACUGACAGAGAAGUUUCCA |
| 1251 | 795 | GUCCAGGUUGAUUCACUCCAA |
| 1252 | 796 | CCGACCUAAACCAAGCACGUU |
| 1253 | 797 | AGUUGGAGAGCUAAAUGUGCG |
| 1254 | 798 | CAUAUUGUAGUCUCCAAUAUG |
| 1255 | 799 | CAUUAUGUAAUAUUAAAGGCA |
| 1256 | 800 | CUACACUUGUUAUCAAUGCAC |
| 1257 | 801 | AACCAUAUUUAUUUGAAUACU |
| 1258 | 802 | AUAUUAAAGGCAAGUCACAUA |
| 1259 | 803 | ACCAAGCUAAGCACUUCACAU |
| 1260 | 804 | GAAAGAUACCUUUACUUUGGG |
| 1261 | 805 | UUAAGGCAAGUCUGUCUUACU |
| 1262 | 806 | AAUUGCAUCAUUAGAAUAAG |
| 1263 | 807 | CAUGAUAUAAGGUCCAGGUUG |
| 1264 | 808 | AUAGCAGUAAGCAGAACAAUA |
| 1265 | 809 | CAAUAAAUGCAUGAGAAUGUG |
| 1266 | 810 | AGAAGUUUCCAUCCAAAUUUU |
| 1267 | 811 | AAGCAUCUGCUUCAAAGUUAU |
| 1268 | 812 | CACUUGUUAUCAAUGCACUGU |
| 1269 | 813 | AUUCGACGCGCCUCUUCACAG |
| 1270 | 814 | AAGCUGAAUGCCUAAUGACUC |
| 1271 | 815 | UCCAUAUUGUAGUCUCCAAUA |
| 1272 | 816 | AUAUUAAUAAUGACAACUACC |
| 1273 | 817 | CUUUAAACAUUCGACGCGCCU |
| 1274 | 818 | CUUCGAGGGACAUUGUGAGGG |
| 1275 | 819 | AUGAAGCUGAAUGCCUAAUGA |
| 1276 | 820 | GAACCCACUGCUUCAUCCCAG |
| 1277 | 821 | AAAUGUGAAGUUCACAAUACA |
| 1278 | 822 | ACCGAUGAGAGCUAUAGCAGU |
| 1279 | 823 | CUUUGUAUAUCCUUUACUUAG |
| 1280 | 824 | GUCGUCAGGAAUAAAUCUGCU |
| 1281 | 825 | AGUCUGCAAAUGCUGACUGUC |
| 1282 | 826 | UGUUAUCAAUGCACUGUGAUU |
| 1283 | 827 | AUACACAAACACUGGAGUACA |
| 1284 | 828 | GUUGGAGAGCUAAAUGUGCGG |
| 1285 | 829 | AUUGAAGUCUGAAUGUAAAUU |
| 1286 | 830 | CCUUGUGACAUAUUCAAACCA |
| 1287 | 831 | UCAGCUCCCAGUAGACUUUAA |
| 1288 | 832 | ACAGCACUACAGAAAUAGAGAA |
| 1289 | 833 | CUACAAUGUCCAAGAUUCCAU |

TABLE 4-continued

Results for ITFG1.
Score threshold: 70. Design: siRNA 21 nt.

| SEQ ID NO | siRNA_id | siRNA guide strand/ AS Sequence |
|---|---|---|
| 1290 | 834 | ACUGCUUCAUCCCAGAUCUCA |
| 1291 | 835 | ACCACUUACUCUGUGCUAGGC |
| 1292 | 836 | AGAAUAGAGAACCCAAAUUUU |
| 1293 | 837 | ACUAAGAACAAUAACUUUAAC |
| 1294 | 838 | AUUGUGAGGGUAUGGAAUGAC |
| 1295 | 839 | ACAUCAUUUAUAAAUAAUAUU |
| 1296 | 840 | UUCAAACUGGAAGGUACUAGU |
| 1297 | 841 | ACUCCAAAGGGUGUUAUCUUA |
| 1298 | 842 | UGAGGGUAUGGAAUGACAAUU |
| 1299 | 843 | ACAAUGUCCAAGAUUCCAUCU |
| 1300 | 844 | CUAAGUAGAUGGUACUCUUUU |
| 1301 | 845 | CCAUUUGCAUCUACAGUUGUA |
| 1302 | 846 | AAGAAGCAAGACCAAGUCAAG |
| 1303 | 847 | AGUGGUUGAAUUAGGAGUUUA |
| 1304 | 848 | UAUGUAAUAUUAAAGGCAAGU |
| 1305 | 849 | AAGAUUAUAAAUACACAAACA |
| 1306 | 850 | AAUCUCAGUGAACUAUAAAGA |
| 1307 | 851 | CAACUACCACAUAUUGACCAC |
| 1308 | 852 | ACAAGGGACGUUCUCCAGUAA |
| 1309 | 853 | UGACUCCGUGAUAUAUUCACA |
| 1310 | 854 | CUACCAAGUCAGAGUACCCGA |
| 1311 | 855 | AUGAAACCGGUGGGCUUCUUG |
| 1312 | 856 | UGUGAAGUUCACAAUACAAAA |
| 1313 | 857 | ACUGGAAGGUACUAGUGGUGG |
| 1314 | 858 | UAUUAAGAAGCAUGUUAACA |
| 1315 | 859 | UCUUCACAGCUUGCAUUAUUA |
| 1316 | 860 | ACAUGUUAACAUGCUUAGAUA |
| 1317 | 861 | AAGAUAUGUCAGAAGGACAUC |
| 1318 | 862 | GUUUAAGGCAAGUCUGUCUUA |
| 1319 | 863 | AUUCCUGCUCAUUUAAUUAUU |
| 1320 | 864 | GAAGACAUGUUAACAUGCUUA |
| 1321 | 865 | AAUAUGAAGGGUAAUUGGAAU |
| 1322 | 866 | CAAAUGCUGACUGUCCAACCA |
| 1323 | 867 | UAUAUACAAAGUGCUUUAAAA |
| 1324 | 868 | UAAUGACUCCGUGAUAUAUUC |
| 1325 | 869 | GUCAUUAGAACACAGACCACU |
| 1326 | 870 | AUCCCAUUUAAUGUUUACAGU |

TABLE 4-continued

Results for ITFG1.
Score threshold: 70. Design: siRNA 21 nt.

| SEQ ID NO | siRNA_id | siRNA guide strand/ AS Sequence |
|---|---|---|
| 1327 | 871 | ACAUCAUCCCAUUUAAUGUUU |
| 1328 | 872 | AUACCUUUACUUUGGGUUUAA |
| 1329 | 873 | GAAUAUUCUUCAUGCCUGAA |
| 1330 | 874 | GUCUGUCUUACUGUGCUACCA |
| 1331 | 875 | AGUGUUUGAGAAUAGAAAUGU |
| 1332 | 876 | AUCAUCAUGAUGCAAAUAAGA |
| 1333 | 877 | GUAACUCAAGUAUUAGCCCCA |
| 1334 | 878 | GUUGUAUACAUGAUAUAAGGU |
| 1335 | 879 | UCUCACUAAGUAGAUGGUACU |
| 1336 | 880 | UGAUGAAGCUGAAUGCCUAAU |
| 1337 | 881 | UGCGCUCCGACCUAAACCAAG |
| 1338 | 882 | CAGCUUGCAUUAUUACAAGGG |
| 1339 | 883 | UGGAACCCACUGCUUCAUCCC |
| 1340 | 884 | AUAAGUCUAAUAAGAUCAUCU |
| 1341 | 885 | AAAGGGUGUUAUCUUACGAGG |
| 1342 | 886 | AACGUAGAGAUGGUCAAGAAA |
| 1343 | 887 | AGGGUAUGGAAUGACAAUUAG |
| 1344 | 888 | AUUAGCUGGGAAUUUGGAAUG |
| 1345 | 889 | ACUUCUCCAAGUGUUUGAGAA |
| 1346 | 890 | UCAGUGAACUAUAAAGAAAAA |
| 1347 | 891 | UCUUCAGUCAGAUCAAUAAAU |
| 1348 | 892 | UGGUUGAAUUAGGAGUUUAAG |
| 1349 | 893 | AUGGGAUACAUCAUUUAUAAA |
| 1350 | 894 | CCUUAAUUUGAUUUAGGUCUG |
| 1351 | 895 | AUCAAUAAAUGCAUGAGAAUG |
| 1352 | 896 | AUUUGAGAAUCUCCAUCAUAA |
| 1353 | 897 | UUAGCACUACAAUGUCCAAGA |
| 1354 | 898 | AGAGUGUGCCCUUAUUGCUGA |
| 1355 | 899 | UCCCAUAUUUCAAACUGGAAG |
| 1356 | 900 | GACUUUAAACAUUCGACGCGC |
| 1357 | 901 | GAUUGCAGUCCACUCUUGUUU |
| 1358 | 902 | GUCCAUCUCCAUCAAAGUCUG |
| 1359 | 903 | ACUUUAAACAUUCGACGCGCC |
| 1360 | 904 | CUGUGCUACCAAGUCAGAGUA |
| 1361 | 905 | UCCUAUUGAGUAUGGUCAUAU |
| 1362 | 906 | AGUAUAAUUUGCAUCAUUAGA |
| 1363 | 907 | ACCAACGUAGAGAUGGUCAAG |

TABLE 4-continued

Results for ITFG1.
Score threshold: 70. Design: siRNA 21 nt.

| SEQ ID NO | siRNA_id | siRNA guide strand/ AS Sequence |
|---|---|---|
| 1364 | 908 | ACAUUCGACGCGCCUCUUCAC |
| 1365 | 909 | CAGUUGGUUGCUGUUCAUCCA |
| 1366 | 910 | CUGUCUUACUGUGCUACCAAG |
| 1367 | 911 | AUGCAACACAUUCCACAAAGG |
| 1368 | 912 | AGGACUGGAACCCACUGCUUC |
| 1369 | 913 | UCUCCAAGUGUUUGAGAAUAG |
| 1370 | 914 | UGCUUCAUCCCAGAUCUCACU |
| 1371 | 915 | AAUAUUCUUCAUGCCUGAAA |
| 1372 | 916 | AGAAAUCAAAUGUUCUUCAUU |
| 1373 | 917 | UCUCCAUCAAAGUCUGCAAAU |
| 1374 | 918 | UCAAUAAAUGCAUGAGAAUGU |
| 1375 | 919 | AUCACAUGAUAAGGAUAAGUU |
| 1376 | 920 | ACAGUCAUUAGAACACAGACC |
| 1377 | 921 | UCUGUCAGCUCCCAGUAGACU |
| 1378 | 922 | CAUUGAAAUCCAUAAUUAGUG |
| 1379 | 923 | CUUUGUAAGUGGUUGAAUUAG |
| 1380 | 924 | AAGGCAAGUCACAUAGCAUCA |
| 1381 | 925 | ACUUUGUAAGUGGUUGAAUUA |
| 1382 | 926 | AAAUAAGAUUAUAAAUACACA |
| 1383 | 927 | AUACAUCAUCCCAUUUAAUGU |
| 1384 | 928 | UAAGGUCCAGGUUGAUUCACU |
| 1385 | 929 | GACCACUAAGAACAAUAACUU |
| 1386 | 930 | CUGUGAUGAAGCUGAAUGCCU |
| 1387 | 931 | UGCUAGGCACCAAGCUAAGCA |
| 1388 | 932 | GUACCCGAUCACUAUAUUGUA |
| 1389 | 933 | CACCGAUGAGAGCUAUAGCAG |
| 1390 | 934 | UCCCAGAUGCUGCCUACAGCA |
| 1391 | 935 | CAGUCAGAUCAAUAAAUGCAU |
| 1392 | 936 | AUGCAUGAGAAUGUGGAAUUC |
| 1393 | 937 | UGUAUACAUGAUAUAAGGUCC |
| 1394 | 938 | UCCAAUAAUUACCAUGGGAUA |
| 1395 | 939 | CAAUAUUACUUGGUGUAAGAU |
| 1396 | 940 | AAAGGCAAGUCACAUAGCAUC |
| 1397 | 941 | AUGGUAUUUCAGUUGGUUGC |
| 1398 | 942 | UCCUUUCAAGAAAUCAAAUGU |
| 1399 | 943 | GUAUUUCUAUAAUUAGAUGUA |
| 1400 | 944 | UCCAUUAUGUAAUAUUAAAGG |
| 1401 | 945 | AACACUGGAGUACAUGCAACA |
| 1402 | 946 | AAGAUUUGCAUUCCCAGAUGC |
| 1403 | 947 | GUAGACUUUAAACAUUCGACG |
| 1404 | 948 | CCACUAAGAACAAUAACUUUA |
| 1405 | 949 | GAUUCUUGAAAGAUACCUUUA |
| 1406 | 950 | CAAUUAGCUGGGAAUUUGGAA |
| 1407 | 951 | AGUCUAUGUAUUUCUAUAAUU |
| 1408 | 952 | CACGUUGUAUGGUAGUUGGAG |
| 1409 | 953 | UGCCUAAUGACUCCGUGAUAU |
| 1410 | 954 | UGAAACCGGUGGGCUUCUUGU |
| 1411 | 955 | GUUGAUUCACUCCAAAGGGUG |
| 1412 | 956 | AAUUAGAUCACCAUUGAAAUC |
| 1413 | 957 | UGAUAAAUUCCCUCCUAAUAG |
| 1414 | 958 | AUUCACUCCAAAGGGUGUUAU |
| 1415 | 959 | UGAAUACUUUCCAAUAAUUAC |
| 1416 | 960 | AAUGCUGACUGUCCAACCACC |
| 1417 | 961 | AAUGCACGUGAUUCUUGAAA |
| 1418 | 962 | GAAUUGGUAUUUCAGUUGGUU |
| 1419 | 963 | AUAAUUACCAUGGGAUACAUC |
| 1420 | 964 | AGAUCAAUAAAUGCAUGAGAA |
| 1421 | 965 | GCUGAAAUCUUGUAGGACUGG |
| 1422 | 966 | AUUCAUUUGUGAUACCAAAAA |
| 1423 | 967 | GUUCAAACAAUGACUUUGUAA |
| 1424 | 968 | AUUCCAUUAUGUAAUAUUAAA |
| 1425 | 969 | GUACAUGCAACACAUUCCACA |
| 1426 | 970 | AUUCCCAGAUGCUGCCUACAG |
| 1427 | 971 | AGUCUGAAUGUAAAUUAUAGA |
| 1428 | 972 | CACAGCUUGCAUUAUUACAAG |
| 1429 | 973 | CAAUAUGAAGGGUAAUUGGAA |
| 1430 | 974 | CAUCUCCAUCAAAGUCUGCAA |
| 1431 | 975 | AGUCUAAUAAGAUCAUCUAAA |
| 1432 | 976 | UGCUGUGAUGAAGCUGAAUGC |
| 1433 | 977 | CUUUACUUAGCACUACAAUGU |
| 1434 | 978 | AUGUUAACAUGCUUAGAUACA |
| 1435 | 979 | UGCUUAGAUACAAAGUAAAAA |
| 1436 | 980 | AUGGUCAUAUUGUUAGGAUCU |
| 1437 | 981 | AACAUUCGACGCGCCUCUUCA |

TABLE 4-continued

Results for ITFG1.
Score threshold: 70. Design: siRNA 21 nt.

| SEQ ID NO | siRNA_id | siRNA guide strand/ AS Sequence |
|---|---|---|
| 1438 | 982 | UACCUUUACUUUGGGUUUAAA |
| 1439 | 983 | GUGAUGAAGCUGAAUGCCUAA |
| 1440 | 984 | AGGGCACAUUAAUUCUUGGAG |
| 1441 | 985 | ACAGCAGUUUCCUUUCAAGAA |
| 1442 | 986 | AUGCUUAGAUACAAAGUAAAA |
| 1443 | 987 | ACUCCGUGAUAUAUUCACAAA |
| 1444 | 988 | UCUUUAUGUCAAUCACCAAAA |
| 1445 | 989 | GAUUGAAGAUUUGCAUUCCCA |
| 1446 | 990 | AUUAGGAGUUUAAGGCAAGUC |
| 1447 | 991 | AAUUUGGAAUGAUUGCAGUCC |
| 1448 | 992 | UCCCAGAUCUCACUAAGUAGA |
| 1449 | 993 | CACUAAGUAGAUGGUACUCUU |
| 1450 | 994 | UGCAUCAUUAGAAUAAGAAGC |
| 1451 | 995 | AGAUGUAUAAGUCUAAUAAGA |
| 1452 | 996 | UUGUGAGGGUAUGGAAUGACA |
| 1453 | 997 | AGUCAGAGUACCCGAUCACUA |
| 1454 | 998 | CUGUGCUAGGCACCAAGCUAA |
| 1455 | 999 | GUAUAAUUUGCAUCAUUAGAA |
| 1456 | 1000 | UAAUUACCAUGGGAUACAUCA |
| 1457 | 1001 | CACAUUAAUUCUUGGAGAGUA |
| 1458 | 1002 | CUUGAAAGAUACCUUUACUUU |
| 1459 | 1003 | CUGCCUACAGCAGUUUCCUUU |
| 1460 | 1004 | AAGACCAAGUCAAGUGGACAC |
| 1461 | 1005 | GGAAUUGGUAUUUCAGUUGGU |
| 1462 | 1006 | CCAUAUUUCAAACUGGAAGGU |
| 1463 | 1007 | GAACAAUAUUACUUGGUGUAA |
| 1464 | 1008 | CAAGUCUAUGUAUUUCUAUAA |
| 1465 | 1009 | AAGAUUCCAUCUUCGUAAAUG |
| 1466 | 1010 | ACAUGAUAAGGAUAAGUUUUU |
| 1467 | 1011 | ACAUACAUCAUCCCAUUUAAU |
| 1468 | 1012 | GACAUGUUAACAUGCUUAGAU |
| 1469 | 1013 | UGGUAGUUGGAGAGCUAAAUG |
| 1470 | 1014 | CUAUAGCAGUAAGCAGAACAA |
| 1471 | 1015 | CUUCAUCCCAGAUCUCACUAA |
| 1472 | 1016 | CUCUGUGCUAGGCACCAAGCU |
| 1473 | 1017 | AAGGUCCAGGUUGAUUCACUC |
| 1474 | 1018 | GACUGGAACCCACUGCUUCAU |
| 1475 | 1019 | AUCACAUGUCCAUUUGCAUAC |
| 1476 | 1020 | CUACAGAAUAGAGAACCCAAA |
| 1477 | 1021 | AAUGACAAUUAGCUGGGAAUU |
| 1478 | 1022 | GUAAAUCUUUAUGUCAAUCAC |
| 1479 | 1023 | GUAUGGUAGUUGGAGAGCUAA |
| 1480 | 1024 | CAUCCUUAAUUUGAUUUAGGU |
| 1481 | 1025 | AUCUUACGAGGACAGUCAUUA |
| 1482 | 1026 | CACAUGAUAAGGAUAAGUUUU |

TABLE 5

Results for ABCC4.
Score threshold: 70. Design: siRNA 21 nt.

| SEQ ID NO | siRNA_id | siRNA guide strand/ AS Sequence |
|---|---|---|
| 1483 | 1 | UUAACAGUGAUGACUUCCCUG |
| 1484 | 2 | UUGACAAAUACACAGUUCGAA |
| 1485 | 3 | UUAAGAUCUAGCUUCUCGGUU |
| 1486 | 4 | UAACACUUUAUGAUUGCUCUU |
| 1487 | 5 | UUCACUUUCCUCAUUAUCCUU |
| 1488 | 6 | UUCAAUAUCAGAAUCUGACUU |
| 1489 | 7 | UUAAACCUGAAUAAAUUCCUA |
| 1490 | 8 | UAGAAUACCAAUAGAGAUCUU |
| 1491 | 9 | UGCACUGAGAGGAUCGUCCAG |
| 1492 | 10 | UCAUCUUCCUCUAAUCUCCGU |
| 1493 | 11 | UAUAACUUCAUUCAUGGUCCU |
| 1494 | 12 | UUUGACAAAUACACAGUUCGA |
| 1495 | 13 | AUAACUUCAUUCAUGGUCCUG |
| 1496 | 14 | UUAAAGAAGGCUUCUGUGCGU |
| 1497 | 15 | UGUAAGAACACUGUCACCUGA |
| 1498 | 16 | UAAGAUUUCCAGUAACACUUU |
| 1499 | 17 | UCAUUCAUGGUCCUGAUCCUG |
| 1500 | 18 | UCAGAAUCUGACUUGCAGCUU |
| 1501 | 19 | UACACGGGCAGCAUCUUGCCG |
| 1502 | 20 | AUACAUAUCAUCUUCCUCUAA |
| 1503 | 21 | UGAAGAGUUAACAAGGACGUA |
| 1504 | 22 | UUUGUGAAGAGUUAACAAGGA |
| 1505 | 23 | UCUAUCAAAGAAUAAUACCGG |

TABLE 5-continued

Results for ABCC4.
Score threshold: 70. Design: siRNA 21 nt.

| SEQ ID NO | siRNA_id | siRNA guide strand/ AS Sequence |
|---|---|---|
| 1506 | 24 | UGAUAUCUCAUCAAGUAGCAA |
| 1507 | 25 | UGACAUUUAGCAUACUUUGUU |
| 1508 | 26 | AAACUUGUUCACAUCAUUGGA |
| 1509 | 27 | UUUACAGUGACAUUUAGCAUA |
| 1510 | 28 | AUUUACAGUGACAUUUAGCAU |
| 1511 | 29 | AAGCACAUAGGCAACAUCUUG |
| 1512 | 30 | UUCUCGGUUACAUUUCCUCCU |
| 1513 | 31 | UAAACCUGAAUAAAUUCCUAA |
| 1514 | 32 | AAUCUUGGAAAUCUCCUUCUU |
| 1515 | 33 | UAUUACUCCUCAGAGUUCCCG |
| 1516 | 34 | UUCCUAUUGGAUUUCUAUCAA |
| 1517 | 35 | AUACCAAUAGAGAUCUUGCUA |
| 1518 | 36 | UUUCCAGUAACACUUUAUGAU |
| 1519 | 37 | UUGCUCUUGUUAAAGAAGGCU |
| 1520 | 38 | UAUCAAAGAAUAAUACCGGAG |
| 1521 | 39 | UGAGGUACUGCAACUGAUGAG |
| 1522 | 40 | UUCCGCAUCUACUGCACUGAG |
| 1523 | 41 | UGAAUACAUAUCAUCUUCCUC |
| 1524 | 42 | AUCACCAUCCUCCAACAGCUG |
| 1525 | 43 | UUGCAACUCCUCUCCAAGGUG |
| 1526 | 44 | UUGUUAAAGAAGGCUUCUGUG |
| 1527 | 45 | UCUUGAUACACUGCUCUUGCA |
| 1528 | 46 | UUUCAGAAUUGACUCAAACAU |
| 1529 | 47 | AGUGAUGAGAACAACUUCCCA |
| 1530 | 48 | UCAAUAUCAGAAUCUGACUUG |
| 1531 | 49 | AAUCUUGAAGCACAUAGGCAA |
| 1532 | 50 | UCUUCCAUGCACGCUGACCAG |
| 1533 | 51 | AAGAUUCCAGUAACACUUUA |
| 1534 | 52 | UACUGCACUGAGAGGAUCGUC |
| 1535 | 53 | UAAGAUCUAGCUUCUCGGUUA |
| 1536 | 54 | UUAGUGUGGGAGUUCCUGGAA |
| 1537 | 55 | AACACUUUAUGAUUGCUCUUG |
| 1538 | 56 | UACACUGCUCUUGCAAGGUUU |
| 1539 | 57 | AUAUCAGAAUCUGACUUGCAG |
| 1540 | 58 | AUAGAGAUCUUGCUAUGCCAA |
| 1541 | 59 | AAUACAUAUCAUCUUCCUCUA |
| 1542 | 60 | UACACAGUUCGAACAAGUGUC |
| 1543 | 61 | UAUUGGAUUUCUAUCAAAGAA |
| 1544 | 62 | AUCAUCUUCCUCUAAUCUCCG |
| 1545 | 63 | UAGAAGAUUGUUGAGACCAAA |
| 1546 | 64 | UACCAAUAGAGAUCUUGCUAU |
| 1547 | 65 | UUGUGAAGAGUUAACAAGGAC |
| 1548 | 66 | UGCUCUUGCAAGGUUUACCCG |
| 1549 | 67 | AUACUUUGUUUGUUUGCCCAG |
| 1550 | 68 | UUUAUACCAGUUAUAACUUCAU |
| 1551 | 69 | UAAAUUCCUAAGUACCAGUUA |
| 1552 | 70 | UUGCCUCUGACACCCUCUCAA |
| 1553 | 71 | UAACUUCCGCAUCUACUGCAC |
| 1554 | 72 | UAUUCCUAUCUCCAUCCAGAG |
| 1555 | 73 | AUACACAGUUCGAACAAGUGU |
| 1556 | 74 | UUACUCCUCAGAGUUCCCGAG |
| 1557 | 75 | AACAAGGACGUAGAAUACCAA |
| 1558 | 76 | UUUAGCAUACUUUGUUUGUUU |
| 1559 | 77 | UCAGCAUCUUGAUACACUGCU |
| 1560 | 78 | UGCAGCUUUGAGGUACUGCAA |
| 1561 | 79 | AGAUUGUUGAGACCAAACCGA |
| 1562 | 80 | UUGAGGUACUGCAACUGAUGA |
| 1563 | 81 | UAUACCAGUUAUAACUUCAUU |
| 1564 | 82 | UUAGCAUACUUUGUUUGUUUG |
| 1565 | 83 | UUCUUUAUCCCAGAACCCUUG |
| 1566 | 84 | AAUACCAAUAGAGAUCUUGCU |
| 1567 | 85 | UUCAGAAUUGACUCAAACAUU |
| 1568 | 86 | UCUGAGGCAGGAACUUCUCAG |
| 1569 | 87 | UGUCACCUGAUCAAACUUGUU |
| 1570 | 88 | UCUUUCAAUAUCAGAAUCUGA |
| 1571 | 89 | UUGGAAAUCUCCUUCUUUCUC |
| 1572 | 90 | UUACAUUUCCUCCUCCAUUUA |
| 1573 | 91 | AUCUUGGAAAUCUCCUUCUUU |
| 1574 | 92 | UUCUAUCAAGAAUAAUACCG |
| 1575 | 93 | UGCGCUGUGAUAUCUCAUCAA |
| 1576 | 94 | AAGAUUGUUGAGACCAAACCG |
| 1577 | 95 | UUGCAAGGUUUACCCGUGCUU |
| 1578 | 96 | UCCAUUUCAGUGACAUUUAG |
| 1579 | 97 | UGAGACACAUAGGCAAUUCUU |

TABLE 5-continued

Results for ABCC4.
Score threshold: 70. Design: siRNA 21 nt.

| SEQ ID NO | siRNA_id | siRNA guide strand/ AS Sequence |
|---|---|---|
| 1580 | 98 | UAAGUACCAGUUAAGAUCUAG |
| 1581 | 99 | AUUUAGCAUACUUUGUUUGUU |
| 1582 | 100 | UCUUGUUAAAGAAGGCUUCUG |
| 1583 | 101 | AAUAGAGAUCUUGCUAUGCCA |
| 1584 | 102 | UGUCAGCAUCUUGAUACACUG |
| 1585 | 103 | UACAGUGACAUUUAGCAUACU |
| 1586 | 104 | UGAGCAGAGGUUCGCGUCCUG |
| 1587 | 105 | UGACAGUAAAGGAAAGGCCUU |
| 1588 | 106 | ACAAGUGUCUGCUAACUUCCG |
| 1589 | 107 | AUACACUGCUCUUGCAAGGUU |
| 1590 | 108 | UCACAGUCAGAUCACCAUCCU |
| 1591 | 109 | UUUGAGGUACUGCAACUGAUG |
| 1592 | 110 | ACACAUAGGCAAUUCUUCCAU |
| 1593 | 111 | AUAGAUGUCAGCAUCUUGAUA |
| 1594 | 112 | UUUACCCGUGCUUUCUGCCCU |
| 1595 | 113 | UUCCUGGAACUGGAGGUUGUU |
| 1596 | 114 | AGUCAGAUCACCAUCCUCCAA |
| 1597 | 115 | UUUAUCCCAGAACCCUUGCAA |
| 1598 | 116 | UUCCUAUCUCCAUCCAGAUA |
| 1599 | 117 | UUCCUCAUUAUCCUUCUUUAA |
| 1600 | 118 | AAUCUGACUUGCAGCUUUGAG |
| 1601 | 119 | CACAGUUCGAACAAGUGUCUG |
| 1602 | 120 | UACCAGUUAAGAUCUAGCUUC |
| 1603 | 121 | AGUUCGAACAAGUGUCUGCUA |
| 1604 | 122 | AAGUGUCUGCUAACUUCCGCA |
| 1605 | 123 | UCUGACUUGCAGCUUUGAGGU |
| 1606 | 124 | UCUCGGUUACAUUUCCUCCUC |
| 1607 | 125 | UUCAUUCAUGGUCCUGAUCCU |
| 1608 | 126 | UACGAUUCCUUAGUGUGGGAG |
| 1609 | 127 | UCCAACAGCUGUAAAUCCUUU |
| 1610 | 128 | UUGUGCAAAGUUUGUGAAGAG |
| 1611 | 129 | AAUAUCAGAAUCUGACUUGCA |
| 1612 | 130 | UCUUCCUCUAAUCUCCGUUUA |
| 1613 | 131 | AUAAGAUUUCCAGUAACACUU |
| 1614 | 132 | AUCCUGCACAUGCACCAUCUU |
| 1615 | 133 | AUCUUUCAUAUCAGAAUCUG |
| 1616 | 134 | UCCUGCACAUGCACCAUCUUU |
| 1617 | 135 | AACCCUUGCAACUCCUCUCCA |
| 1618 | 136 | UCCUUCUUUCUCAAAUUGGUA |
| 1619 | 137 | UACUAAGACGAAGUGCCUCAA |
| 1620 | 138 | UCACCAUCCUCCAACAGCUGU |
| 1621 | 139 | UGUCUUUGGAGAAACGAUUUA |
| 1622 | 140 | UGUGAUCACACUGCCGAGGAG |
| 1623 | 141 | ACCACAGCUAACAUUCGCCA |
| 1624 | 142 | UUCACAUCAUUGGACAGCAGA |
| 1625 | 143 | UUCUGCCCUCCACUCAGCGUG |
| 1626 | 144 | UUUAUGAUUGCUCUUGUUAAA |
| 1627 | 145 | ACCAGUUAUAACUUCAUUCAU |
| 1628 | 146 | UCUCCAUCCAGAGUAGGGCAG |
| 1629 | 147 | CAUCUUGAUACACUGCUCUUG |
| 1630 | 148 | UUCAAGGAGGGUCUAGAAGAU |
| 1631 | 149 | UAAAGAAGGCUUCUGUGCGUC |
| 1632 | 150 | UUGAUACACUGCUCUUGCAAG |
| 1633 | 151 | UUUCCUCCUCCAUUUACAGUG |
| 1634 | 152 | AAGUGUCCAAUGUCUUUGGAG |
| 1635 | 153 | UCUGAGAAGGUACGAUUCCUU |
| 1636 | 154 | ACAAAUACACAGUUCGAACAA |
| 1637 | 155 | UCAGAAUCUUGGAAAUCUCCU |
| 1638 | 156 | UUUCUGCCCUCCACUCAGCGU |
| 1639 | 157 | AGUGUCUGCUAACUUCCGCAU |
| 1640 | 158 | UAAAGGAAAGGCCUUGUAGAG |
| 1641 | 159 | UUCUGUGCGUCAUUCUCAGCU |
| 1642 | 160 | UCCUUAGUGGGAGUUCCUG |
| 1643 | 161 | CUGACUUGCAGCUUUGAGGUA |
| 1644 | 162 | AACAGUGAUGACUUCCCUGCU |
| 1645 | 163 | UCUAGCUUCUCGGUUACAUUU |
| 1646 | 164 | UCUAGAAGAUUGUUGAGACCA |
| 1647 | 165 | UAACCGUCAGCCGCACAGCCC |
| 1648 | 166 | UUGGACAGCAGAUUGACUAUC |
| 1649 | 167 | UAGGAACUCAGUGUAAGUCCC |
| 1650 | 168 | AUGCACGCUGACCAGCCCGUG |
| 1651 | 169 | AUAUCAUCUUCCUCUAAUCUC |
| 1652 | 170 | UUCCAGUAACACUUUAUGAUU |
| 1653 | 171 | ACUGAGAGGAUCGUCCAGGAG |

TABLE 5-continued

Results for ABCC4.
Score threshold: 70. Design: siRNA 21 nt.

| SEQ ID NO | siRNA_id | siRNA guide strand/ AS Sequence |
|---|---|---|
| 1654 | 172 | UUACCCGUGCUUUCUGCCCUC |
| 1655 | 173 | UAUCAUCUUCCUCUAAUCUCC |
| 1656 | 174 | CUUAACAGUGAUGACUUCCCU |
| 1657 | 175 | AAAUUCAUCCCUCUGAGGCAG |
| 1658 | 176 | UCCAAGUGUCCAAUGUCUUUG |
| 1659 | 177 | AUGAUUGCUCUUGUUAAAGAA |
| 1660 | 178 | UGUGCGUCAUUCUCAGCUCUU |
| 1661 | 179 | UGAGGCAGGAACUUCUCAGAA |
| 1662 | 180 | UUCACCUCCUGGUACACGGGC |
| 1663 | 181 | UCCAGUAACACUUUAUGAUUG |
| 1664 | 182 | UCAAACUUGUUCACAUCAUUG |
| 1665 | 183 | UAACAGUGAUGACUUCCCUGC |
| 1666 | 184 | UAUCACAGUCGAUCACCAUC |
| 1667 | 185 | UAGCAUACUUUGUUUGUUUGC |
| 1668 | 186 | AAGACUCUGAGAAGGUACGAU |
| 1669 | 187 | AACUUGUUCACAUCAUUGGAC |
| 1670 | 188 | AGCAUCUUGAUACACUGCUCU |
| 1671 | 189 | UUGCGCUGUGAUAUCUCAUCA |
| 1672 | 190 | UGGAGGUUGUUCACUUUCCUC |
| 1673 | 191 | UAUCUCAUCAAGUAGCAAAAA |
| 1674 | 192 | UGGUGAAGGUCACAAACACGA |
| 1675 | 193 | AAGAGGGUAACCGUCAGCCGC |
| 1676 | 194 | UAUCAGAAUCGACUUGCAGC |
| 1677 | 195 | ACAUUUAGCAUACUUUGUUUG |
| 1678 | 196 | UAACAAGGACGUAGAAUACCA |
| 1679 | 197 | UUGCAGCUUUGAGGUACUGCA |
| 1680 | 198 | GUUAAGAUCUAGCUUCUCGGU |
| 1681 | 199 | AGGGUCUAGAAGAUUGUUGAG |
| 1682 | 200 | UAACUUCAUUCAUGGUCCUGA |
| 1683 | 201 | AUAAAUUCCUAAGUACCAGUU |
| 1684 | 202 | UUCCUUAGUGUGGGAGUUCCU |
| 1685 | 203 | AGAAUGACUCAAACAUUUUG |
| 1686 | 204 | UGUUACUAAGACGAAGUGCCU |
| 1687 | 205 | AGUCACUGCAAUCGCCUGCAG |
| 1688 | 206 | AGGAAGUGUAAGAACACUGUC |
| 1689 | 207 | CUUGAUACACUGCUCUUGCAA |
| 1690 | 208 | UCGGUUACAUUUCCUCCUCCA |

TABLE 5-continued

Results for ABCC4.
Score threshold: 70. Design: siRNA 21 nt.

| SEQ ID NO | siRNA_id | siRNA guide strand/ AS Sequence |
|---|---|---|
| 1691 | 209 | UAGGGCAGUCACUGCAAUCGC |
| 1692 | 210 | UCAAAGAAUAAUACCGGAGCU |
| 1693 | 211 | UUCUUCCUAUUGGAUUUCUAU |
| 1694 | 212 | UCAGAAUUGACUCAAACAUUU |
| 1695 | 213 | UUGUUCACAUCAUUGGACAGC |
| 1696 | 214 | UAUUAUCCUUAUACCAGUUAU |
| 1697 | 215 | UUGAAGCACAUAGGCAACAUC |
| 1698 | 216 | UGCUAACUUCCGCAUCUACUG |
| 1699 | 217 | GUGAUGAGAACAACUUCCCAA |
| 1700 | 218 | UCUCCAAGGUGCUGUGAGCGG |
| 1701 | 219 | UAUCUCCAUCCAGAGUAGGGC |
| 1702 | 220 | UACCAUCUUUCAAUAUCAGAA |
| 1703 | 221 | UCGUCCAGGAGAUAGAUGUCA |
| 1704 | 222 | AUCCAAGUGUCCAAUGUCUUU |
| 1705 | 223 | AGCUUUGAGGUACUGCAACUG |
| 1706 | 224 | AUUGCCUCUGACACCCUCUCA |
| 1707 | 225 | CAGAAUCUUGGAAAUCUCCUU |
| 1708 | 226 | UCUCCUUCUUUCUCAAAUUGG |
| 1709 | 227 | ACUUCUUUAUCCCAGAACCCU |
| 1710 | 228 | ACUUCCUCAUUAUCCUUCUU |
| 1711 | 229 | UACAUAUCAUCUUCCUCUAAU |
| 1712 | 230 | CUAACUUCCGCAUCUACUGCA |
| 1713 | 231 | UCGGAUGCUGACGAUUGCCUC |
| 1714 | 232 | AAUACACAGUUCGAACAAGUG |
| 1715 | 233 | AAGUUUGUGAAGAGUUAACAA |
| 1716 | 234 | UCAAAUGGUAAUAAGAUUUG |
| 1717 | 235 | ACUUGCAGCUUUGAGGUACUG |
| 1718 | 236 | UUGCAAGGGCAGGAGAAUGAU |
| 1719 | 237 | GAUAUUCCUAUCUCCAUCCAG |
| 1720 | 238 | UCCUAUUGGAUUUCUAUCAAA |
| 1721 | 239 | UGGUACACGGGCAGCAUCUUG |
| 1722 | 240 | ACUGUCACCUGAUCAAACUUG |
| 1723 | 241 | UGGAAAUCUCCUUCUUUCUCA |
| 1724 | 242 | AGUUAAGAUCUAGCUUCUCGG |
| 1725 | 243 | AUUUCCAGUAACACUUUAUGA |
| 1726 | 244 | AUCAGAAUCUGACUUGCAGCU |
| 1727 | 245 | AAGAAGGCUUCUGUGCGUCAU |

TABLE 5-continued

Results for ABCC4.
Score threshold: 70. Design: siRNA 21 nt.

| SEQ ID NO | siRNA_id | siRNA guide strand/ AS Sequence |
|---|---|---|
| 1728 | 246 | ACCCUUGCAACUCCUCUCCAA |
| 1729 | 247 | UGACCAGCCCGUGACUUGGGG |
| 1730 | 248 | CUAAGUACCAGUUAAGAUCUA |
| 1731 | 249 | UUCCCGAGAACACCCAGGGCU |
| 1732 | 250 | UACUUUGUUUGUUUGCCCAGU |
| 1733 | 251 | AAUUCUUCCAUGCACGCUGAC |
| 1734 | 252 | UCAGUGAUGAGAACAACUUCC |
| 1735 | 253 | AUGACUUCCCUGCUCCCACGG |
| 1736 | 254 | AUUCUUCCUAUUGGAUUUCUA |
| 1737 | 255 | UUUCCUCAUUAUCCUUCUUUA |
| 1738 | 256 | UACCGGAGCUUUCAGAAUUGA |
| 1739 | 257 | AUAGGCAAUUCUUCCAUGCAC |
| 1740 | 258 | UUUCAAUAUCAGAAUCUGACU |
| 1741 | 259 | AGUUAUAACUUCAUUCAUGGU |
| 1742 | 260 | UUCGGAUGCUGACGAUUGCCU |
| 1743 | 261 | CAAGUGUCUGCUAACUUCCGC |
| 1744 | 262 | UCUGCUAACUUCCGCAUCUAC |
| 1745 | 263 | UGGGAGUUCCUGGAACUGGAG |
| 1746 | 264 | CUAUCAAAGAAUAAUACCGGA |
| 1747 | 265 | ACUUCCGCAUCUACUGCACUG |
| 1748 | 266 | UUCUCAAAUUGGUAAUAAGAU |
| 1749 | 267 | AUUGUUGAGACCAAACCGAAG |
| 1750 | 268 | CAAUCUUGAAGCACAUAGGCA |
| 1751 | 269 | UGUCCGCUCGGCUGGAGCCUG |
| 1752 | 270 | AGGAGGGUCUAGAAGAUUGUU |
| 1753 | 271 | UGCUCUUGUUAAAGAAGGCUU |
| 1754 | 272 | UUUGUUUGUUUGCCCAGUAUG |
| 1755 | 273 | UUCCUAAGUACCAGUUAAGAU |
| 1756 | 274 | UCUCCUAUCACAGUCAGAUCA |
| 1757 | 275 | UCACAUCAUUGGACAGCAGAU |
| 1758 | 276 | UACCAGUUAUAACUUCAUUCA |
| 1759 | 277 | UUACAGUGACAUUUAGCAUAC |
| 1760 | 278 | UGACUUCCCUGCUCCCACGGG |
| 1761 | 279 | UAGCUUCUCGGUUACAUUUCC |
| 1762 | 280 | AAAUUGGUAAUAAGAUUUGAA |
| 1763 | 281 | ACAGUGACAUUUAGCAUACUU |
| 1764 | 282 | CAAGUGUCCAAUGUCUUUGGA |
| 1765 | 283 | AGAGUUAACAAGGACGUAGAA |
| 1766 | 284 | GUACCAGUUAAGAUCUAGCUU |
| 1767 | 285 | AUUGGACAGCAGAUUGACUAU |
| 1768 | 286 | AGAAUCUGACUUGCAGCUUUG |
| 1769 | 287 | UGGAUUUCUAUCAAAGAAUAA |
| 1770 | 288 | AGAAUACCAAUAGAGAUCUUG |
| 1771 | 289 | UGAAUAAAUUCCUAAGUACCA |
| 1772 | 290 | AUCAAACUUGUUCACAUCAUU |
| 1773 | 291 | AUCAUUGGACAGCAGAUUGAC |
| 1774 | 292 | UCAGCGGCAGCAAAUCAUCCA |
| 1775 | 293 | AGUGACAUUUAGCAUACUUUG |
| 1776 | 294 | CACUUUAUGAUUGCUCUUGUU |
| 1777 | 295 | UAGAUGUCAGCAUCUUGAUAC |
| 1778 | 296 | CAUCUUCCUCUAAUCUCCGUU |
| 1779 | 297 | CUGAAUACAUAUCAUCUUCCU |
| 1780 | 298 | ACAGUGAUGACUUCCCUGCUC |
| 1781 | 299 | UUAUCCUUAUACCAGUUAUAA |
| 1782 | 300 | UCCUUAUACCAGUUAUAACUU |
| 1783 | 301 | UGUUGUGCAAAGUUUGUGAAG |
| 1784 | 302 | UGACUUGCAGCUUUGAGGUAC |
| 1785 | 303 | ACUGCAACUGAUGAGUCACUA |
| 1786 | 304 | ACACGGGCAGCAUCUUGCCGG |
| 1787 | 305 | UGUUUGUUUGCCCAGUAUGAA |
| 1788 | 306 | AUUUGACAAAUACACAGUUCG |
| 1789 | 307 | UUCGCGUCCUGCAGCGGGUUG |
| 1790 | 308 | UUAUGAUUGCUCUUGUUAAAG |
| 1791 | 309 | UCUGUGCGUCAUUCUCAGCUC |
| 1792 | 310 | AAGGUCACAAACACGAUGAUU |
| 1793 | 311 | UUCCUCCUCCAUUUACAGUGA |
| 1794 | 312 | UCUCAGAAUCUUGGAAAUCUC |
| 1795 | 313 | UGAUACACUGCUCUUGCAAGG |
| 1796 | 314 | UUGUUGAGACCAAACCGAAGA |
| 1797 | 315 | AUUGUGAUCUUCUCAUGCAAA |
| 1798 | 316 | AGAGUUCCCGAGAACACCCAG |
| 1799 | 317 | ACAGGAAGUGUAAGAACACUG |
| 1800 | 318 | AAGAACACUGUCACCUGAUCA |
| 1801 | 319 | UUACUAAGACGAAGUGCCUCA |

TABLE 5-continued

Results for ABCC4.
Score threshold: 70. Design: siRNA 21 nt.

| SEQ ID NO | siRNA_id | siRNA guide strand/ AS Sequence |
|---|---|---|
| 1802 | 320 | AUCUCCUUCUUUCUCAAAUUG |
| 1803 | 321 | ACACAGUUCGAACAAGUGUCU |
| 1804 | 322 | AUCUUCCUCUAAUCUCCGUUU |
| 1805 | 323 | UCACCUGAUCAAACUUGUUCA |
| 1806 | 324 | UACUGCAACUGAUGAGUCACU |
| 1807 | 325 | UCAAGGAGGGUCUAGAAGAUU |
| 1808 | 326 | UGAGAGGAUCGUCCAGGAGAU |
| 1809 | 327 | AGUGUAAGAACACUGUCACCU |
| 1810 | 328 | UCCUCCUCCAUUUACAGUGAC |
| 1811 | 329 | UAGCUACAGUUAAACCUGAAU |
| 1812 | 330 | UGAGAAGGUACGAUUCCUUAG |
| 1813 | 331 | UUCUUUCUCAAAUUGGUAAUA |
| 1814 | 332 | UCCAGAGUAGGGCAGUCACUG |
| 1815 | 333 | AAAGGCCUUGUAGAGUUGGGG |
| 1816 | 334 | UUAACAAGGACGUAGAAUACC |
| 1817 | 335 | UUGGAUUUCUAUCAAAGAAUA |
| 1818 | 336 | UGCUUUCUGCCCUCCACUCAG |
| 1819 | 337 | UUGUUUGUUUGCCCAGUAUGA |
| 1820 | 338 | UUCAUCCCUCUGAGGCAGGAA |
| 1821 | 339 | AGAAUCUUGGAAAUCUCCUUC |
| 1822 | 340 | UACCAUCUGACGGCAGCUGAC |
| 1823 | 341 | AUUACUCCUCAGAGUUCCCGA |
| 1824 | 342 | GAGAAUGAUUAGAACUGCCAU |
| 1825 | 343 | ACGUAGAAUACCAAUAGAGAU |
| 1826 | 344 | UUGUGAUCUUCUCAUGCAAAA |
| 1827 | 345 | UACAUUCCUCCUCCAUUUAC |
| 1828 | 346 | UGAUCAAACUUGUUCACAUCA |
| 1829 | 347 | GAACUUCUCAGAAUCUUGGAA |
| 1830 | 348 | UUCCUCUAAUCUCCGUUUAUG |
| 1831 | 349 | UAGGCAAUUCUUCCAUGCACG |
| 1832 | 350 | UGUGGGAGUUCCUGGAACUGG |
| 1833 | 351 | AUCUCCAUCCAGAGUAGGGCA |
| 1834 | 352 | AUUCCUAUCUCCAUCCAGAGU |
| 1835 | 353 | UGAAGGUCACAAACACGAUGA |
| 1836 | 354 | UCACUUUCCUCAUUAUCCUUC |
| 1837 | 355 | AAGUGUAAGAACACUGUCACC |
| 1838 | 356 | AGAACACUGUCACCUGAUCAA |
| 1839 | 357 | AACUUCAUUCAUGGUCCUGAU |
| 1840 | 358 | AAGGUUUACCCGUGCUUUCUG |
| 1841 | 359 | UCACUGCAAUCGCCUGCAGUG |
| 1842 | 360 | UCGCCUGCAGUGGUCCUGCCC |
| 1843 | 361 | UCCGCAUCUACUGCACUGAGA |
| 1844 | 362 | UGAGACCAAACCGAAGACUCU |
| 1845 | 363 | UCUUUCAAGGAGGGUCUAGAA |
| 1846 | 364 | AGCUUCUCGGUUACAUUUCCU |
| 1847 | 365 | AACAAGUGUCUGCUAACUUCC |
| 1848 | 366 | GUGUAAGAACACUGUCACCUG |
| 1849 | 367 | CUUUGAGGUACUGCAACUGAU |
| 1850 | 368 | UGAAGCACAUAGGCAACAUCU |
| 1851 | 369 | UUCUUCCAUGCACGCUGACCA |
| 1852 | 370 | AAUAAUACCGGAGCUUUCAGA |
| 1853 | 371 | CAGAUCACCAUCCUCCAACAG |
| 1854 | 372 | UUGAGACCAAACCGAAGACUC |
| 1855 | 373 | AAGAUCUAGCUUCUCGGUUAC |
| 1856 | 374 | AGGAACUUCUCAGAAUCUUGG |
| 1857 | 375 | UCAUCCAAGUGUCCAAUGUCU |
| 1858 | 376 | AUGUCUUUGGAGAAACGAUUU |
| 1859 | 377 | AGGAACUCAGUGUAAGUCCCC |
| 1860 | 378 | CAAAGAAUAAUACCGGAGCUU |
| 1861 | 379 | UGGAACUGGAGGUUGUUCACU |
| 1862 | 380 | AGCACAUAGGCAACAUCUUGG |
| 1863 | 381 | ACGAUUGCCUCUGACACCCUC |
| 1864 | 382 | UGAUGAGAACAACUUCCCAAA |
| 1865 | 383 | UUGGUAAUAAGAUUUGAAAAU |
| 1866 | 384 | UAAUACCGGAGCUUUCAGAAU |
| 1867 | 385 | CAAUCGCCUGCAGUGGUCCUG |
| 1868 | 386 | UGCAAAGUUUGUGAAGAGUUA |
| 1869 | 387 | AAGAACACGCGUGAGCAGAGG |
| 1870 | 388 | UCCUAUCUCCAUCCAGAGUAG |
| 1871 | 389 | AACUUCCGCAUCUACUGCACU |
| 1872 | 390 | AGAAGGUACGAUUCCUUAGUG |
| 1873 | 391 | UGCAACUGAUGAGUCACUAAA |
| 1874 | 392 | UGUCUGCUAACUUCCGCAUCU |
| 1875 | 393 | UCACACUGCCGAGGAGCACGU |

TABLE 5-continued

Results for ABCC4.
Score threshold: 70. Design: siRNA 21 nt.

| SEQ ID NO | siRNA_id | siRNA guide strand/ AS Sequence |
|---|---|---|
| 1876 | 394 | AUGCUGACGAUUGCCUCUGAC |
| 1877 | 395 | GUCUGCUAACUUCCGCAUCUA |
| 1878 | 396 | CAUACUUUGUUUGUUUGCCCA |
| 1879 | 397 | AGUAACACUUUAUGAUUGCUC |
| 1880 | 398 | GAAUAAAUUCCUAAGUACCAG |
| 1881 | 399 | UCUGGAUUCUUCGGAUGCUGA |
| 1882 | 400 | GACAGCAGAUUGACUAUCUGG |
| 1883 | 401 | CUCCAGAGCACCAUCUUUCAA |
| 1884 | 402 | CAGAAGAACACGCGUGAGCAG |
| 1885 | 403 | GUUCACAUCAUUGGACAGCAG |
| 1886 | 404 | UCUCAAAUUGGUAAUAAGAUU |
| 1887 | 405 | UCUGACGGCAGCUGACGGUUG |
| 1888 | 406 | UUGUUCACUUUCCUCAUUAUC |
| 1889 | 407 | AGCACGGCACUUAACAGUGAU |
| 1890 | 408 | GUAGCUACAGUUAAACCUGAA |
| 1891 | 409 | UUUGCCCAGUAUGAAAGCCAC |
| 1892 | 410 | UGGUCCUGCCCACAGGAAGUG |
| 1893 | 411 | AGUUUGUGAAGAGUUAACAAG |
| 1894 | 412 | GAUUGUUGAGACCAAACCGAA |
| 1895 | 413 | CCACAGCUAACAAUUCGCCAG |
| 1896 | 414 | AUCCCUCUGAGGCAGGAACUU |
| 1897 | 415 | CACAGUCAGAUCACCAUCCUC |
| 1898 | 416 | AACUCCUCUCCAAGGUGCUGU |
| 1899 | 417 | UCGAACAAGUGUCUGCUAACU |
| 1900 | 418 | UCUGACAGUAAAGGAAAGGCC |
| 1901 | 419 | UUGGGCUUCACCUCCUGGUAC |
| 1902 | 420 | AUUCUUCGGAUGCUGACGAUU |
| 1903 | 421 | GCACUGAAUACAUAUCAUCUU |
| 1904 | 422 | UAAGACGAAGUGCCUCAAUUA |
| 1905 | 423 | AAUGUCUUUGGAGAAACGAUU |
| 1906 | 424 | CUUGUUCACAUCAUUGGACAG |
| 1907 | 425 | AUCAUCCAAGUGUCCAAUGUC |
| 1908 | 426 | UAAGAACACUGUCACCUGAUC |
| 1909 | 427 | AUCUGACGGCAGCUGACGGUU |
| 1910 | 428 | AGGAUCGUCCAGGAGAUAGAU |
| 1911 | 429 | CAGAAUCUGACUUGCAGCUUU |
| 1912 | 430 | AGCACAAGCCUUUAUGACUUU |
| 1913 | 431 | GAGCUUUCAGAAUUGACUCAA |
| 1914 | 432 | AUCCGUGAAAGUUGCAGUUUU |
| 1915 | 433 | UCCAGGAGAUAGAUGUCAGCA |
| 1916 | 434 | ACACUUUAUGAUUGCUCUUGU |
| 1917 | 435 | UGCAAGGUUUACCCGUGCUUU |
| 1918 | 436 | UGGACCUCAAGCAGGGAUGCU |
| 1919 | 437 | AAAUUCCUAAGUACCAGUUAA |
| 1920 | 438 | GAGACCAAACCGAAGACUCUG |
| 1921 | 439 | ACUUUAUGAUUGCUCUUGUUA |
| 1922 | 440 | UCCUCUCCAAGGUGCUGUGAG |
| 1923 | 441 | AGGUUCGCGUCCUGCAGCGGG |
| 1924 | 442 | UACAGUUAAACCUGAAUAAAU |
| 1925 | 443 | CAGAGCACCAUCUUUCAAGGA |
| 1926 | 444 | ACGGUAGCUACAGUUAAACCU |
| 1927 | 445 | AAGGUACGAUUCCUUAGUGUG |
| 1928 | 446 | AACUUCUCAGAAUCUUGGAAA |
| 1929 | 447 | CUCAGUGAUGAGAACAACUUC |
| 1930 | 448 | CACACUGCCGAGGAGCACGUA |
| 1931 | 449 | AUCUGACUUGCAGCUUUGAGG |
| 1932 | 450 | GAUUCUUCGGAUGCUGACGAU |
| 1933 | 451 | ACUGCAAUCGCCUGCAGUGGU |
| 1934 | 452 | UCCUCCAUUUACAGUGACAUU |
| 1935 | 453 | CAACUCCUCUCCAAGGUGCUG |
| 1936 | 454 | UUCUUCGGAUGCUGACGAUUG |
| 1937 | 455 | AAACCGAAGACUCUGAGAAGG |
| 1938 | 456 | CAGCAUCUUGAUACACUGCUC |
| 1939 | 457 | UCUCCAGAGCACCAUCUUUCA |
| 1940 | 458 | CAAACUUGUUCACAUCAUUGG |
| 1941 | 459 | AGAGUAGGGCAGUCACUGCAA |
| 1942 | 460 | UCUGGAAAUCUCCUUCUUUC |
| 1943 | 461 | UUUCUAUCAAAGAAUAAUACC |
| 1944 | 462 | UCACCUCCUGGUACACGGGCA |
| 1945 | 463 | AUCUACUGCACUGAGAGGAUC |
| 1946 | 464 | UCCGCUCGGCUGGAGCCUGUG |
| 1947 | 465 | AUCUUGAUACACUGCUCUUGC |
| 1948 | 466 | GUUCGAACAAGUGUCUGCUAA |
| 1949 | 467 | AUUCCUCCUCCAUUUACAGU |

TABLE 5-continued

Results for ABCC4.
Score threshold: 70. Design: siRNA 21 nt.

| SEQ ID NO | siRNA_id | siRNA guide strand/ AS Sequence |
|---|---|---|
| 1950 | 468 | UCUUGAAGCACAUAGGCAACA |
| 1951 | 469 | UCCGUGAAAGUUGCAGUUUUA |
| 1952 | 470 | UGACGGCAGCUGACGGUUGCG |
| 1953 | 471 | UCCUGGACCUCAAGCAGGGAU |
| 1954 | 472 | CAUCUGACGGCAGCUGACGGU |
| 1955 | 473 | AAGGAGGGUCUAGAAGAUUGU |
| 1956 | 474 | CUUCUUUAUCCCAGAACCCUU |
| 1957 | 475 | UCCAGAGCACCAUCUUUCAAG |
| 1958 | 476 | ACCGAAGACUCUGAGAAGGUA |
| 1959 | 477 | AAUCAUCCAAGUGUCCAAUGU |
| 1960 | 478 | AAUAAGAUUUCCAGUAACACU |
| 1961 | 479 | CUAGAAGAUUGUUGAGACCAA |
| 1962 | 480 | AAGGACGUAGAAUACCAAUAG |
| 1963 | 481 | UCUUUCUCAAAUUGGUAAUAA |
| 1964 | 482 | UCUCUGAUGCCUUAUCCCAAA |
| 1965 | 483 | UCCAUGCACGCUGACCAGCCC |
| 1966 | 484 | AUUGCUCUUGUUAAAGAAGGC |
| 1967 | 485 | GGAACUUCUCAGAAUCUUGGA |
| 1968 | 486 | UGCGUCAUUCUCAGCUCUUAA |
| 1969 | 487 | UUUCUCAAAUUGGUAAUAAGA |
| 1970 | 488 | AUCGUCCAGGAGAUAGAUGUC |
| 1971 | 489 | UGCAGUGGUCCUGCCCACAGG |
| 1972 | 490 | GUCUGGAUUCUUCGGAUGCUG |
| 1973 | 491 | UGACGAUUGCCUCUGACACCC |
| 1974 | 492 | AAUAAAUUCCUAAGUACCAGU |
| 1975 | 493 | AGCACCAUCUUUCAAGGAGGG |
| 1976 | 494 | GUAAGAACACUGUCACCUGAU |
| 1977 | 495 | UCUUGCAAGGUUUACCCGUGC |
| 1978 | 496 | AGGUUGUUCACUUUCCUCAUU |
| 1979 | 497 | GCAUCUUGAUACACUGCUCUU |
| 1980 | 498 | ACAGUUCGAACAAGUGUCUGC |
| 1981 | 499 | AGCAAAUCAUCCAAGUGUCCA |
| 1982 | 500 | UAGGUGGUGAAGGUCACAAAC |
| 1983 | 501 | CAGAGUUCCCGAGAACACCCA |
| 1984 | 502 | UGUUGAGACCAAACCGAAGAC |
| 1985 | 503 | ACCAAUAGAGAUCUUGCUAUG |
| 1986 | 504 | CAGUUCGAACAAGUGUCUGCU |
| 1987 | 505 | AAAGAAUAAUACCGGAGCUUU |
| 1988 | 506 | UGGAUUCUUCGGAUGCUGACG |
| 1989 | 507 | AUCUAGCUUCUCGGUUACAUU |
| 1990 | 508 | AUAAUACCGGAGCUUUCAGAA |
| 1991 | 509 | GUGACAUUUAGCAUACUUUGU |
| 1992 | 510 | UCAUUGGACAGCAGAUUGACU |
| 1993 | 511 | CUGCACUGAGAGGAUCGUCCA |
| 1994 | 512 | UAUGAUUGCUCUUGUUAAAGA |
| 1995 | 513 | AUCUUGAAGCACAUAGGCAAC |
| 1996 | 514 | UCUACUGCACUGAGAGGAUCG |
| 1997 | 515 | UGUCCAAUGUCUUUGGAGAAA |
| 1998 | 516 | AGUACCAGUUAAGAUCUAGCU |
| 1999 | 517 | CUUAGUGUGGGAGUUCCUGGA |
| 2000 | 518 | UGAUUGCUCUUGUUAAAGAAG |
| 2001 | 519 | CAAAUUGGUAAUAAGAUUUGA |
| 2002 | 520 | GAUAGAUGUCAGCAUCUUGAU |
| 2003 | 521 | UACUCCUCAGAGUUCCCGAGA |
| 2004 | 522 | UCUUCGGAUGCUGACGAUUGC |
| 2005 | 523 | GAAGCACAUAGGCAACAUCUU |
| 2006 | 524 | GAAGACUCUGAGAAGGUACGA |
| 2007 | 525 | CUGUGCGUCAUUCUCAGCUCU |
| 2008 | 526 | AGAGCACCAUCUUUCAAGGAG |
| 2009 | 527 | GACAUUUAGCAUACUUUGUUU |
| 2010 | 528 | CUGCCGAGGAGCACGUAGGUG |
| 2011 | 529 | CUCCAACAGCUGUAAAUCCUU |
| 2012 | 530 | AUUGGUAAUAAGAUUUGAAAA |
| 2013 | 531 | CAGAAUUGACUCAAACAUUUU |
| 2014 | 532 | CUAUCACGUCAGAUCACCAU |
| 2015 | 533 | CUGUGAUAUCUCAUCAAGUAG |
| 2016 | 534 | AGAUAGAUGUCAGCAUCUUGA |
| 2017 | 535 | AUUAUCCUUAUACCAGUUAUA |
| 2018 | 536 | AGAACCCUGCAACUCCCUCUC |
| 2019 | 537 | AUACCGGAGCUUUCAGAAUUG |
| 2020 | 538 | ACGCGUGAGCAGAGGUUCGCG |
| 2021 | 539 | ACAAGGACGUAGAAUACCAAU |
| 2022 | 540 | GUGAAGGUCACAAACACGAUG |
| 2023 | 541 | AAGGCCUUGUAGAGUUGGGGU |

TABLE 5-continued

Results for ABCC4.
Score threshold: 70. Design: siRNA 21 nt.

| SEQ ID NO | siRNA_id | siRNA guide strand/ AS Sequence |
|---|---|---|
| 2024 | 542 | AACCGUCAGCCGCACAGCCCC |
| 2025 | 543 | GAGAUAGAUGUCAGCAUCUUG |
| 2026 | 544 | AAACCUGAAUAAAUUCCUAAG |
| 2027 | 545 | ACGAAGUGCCUCAAUUAACGU |
| 2028 | 546 | UCGUAUUUCUUCCCAAAUAAA |
| 2029 | 547 | UCGCGCUGAUCAGGCGGCGGU |
| 2030 | 548 | UGCUGAGACACAUAGGCAAUU |
| 2031 | 549 | AGAGGGUAACCGUCAGCCGCA |
| 2032 | 550 | GAUCAAACUUGUUCACAUCAU |
| 2033 | 551 | UGUGCAAAGUUUGUGAAGAGU |
| 2034 | 552 | CAGCAAGGCACGAUAUUCCUA |
| 2035 | 553 | UUAUAACUUCAUUCAUGGUCC |
| 2036 | 554 | UUCGAACAAGUGUCUGCUAAC |
| 2037 | 555 | UUUCAAGGAGGGUCUAGAAGA |
| 2038 | 556 | ACAGCUUUGCAAGGGCAGGAG |
| 2039 | 557 | GUGAUGACUUCCCUGCUCCCA |
| 2040 | 558 | UAGUGUGGGAGUUCCUGGAAC |
| 2041 | 559 | UGUGAAGAGUUAACAAGGACG |
| 2042 | 560 | CAAAUACACAGUUCGAACAAG |
| 2043 | 561 | AUACCAGUUAUAACUUCAUUC |
| 2044 | 562 | AUAUUCCUAUCUCCAUCCAGA |
| 2045 | 563 | AAGAAGAGGGUAACCGUCAGC |
| 2046 | 564 | UGCAACUCCUCUCCAAGGUGC |
| 2047 | 565 | GUUACUAAGACGAAGUGCCUC |
| 2048 | 566 | ACGCCUGUCCGCUCGGCUGGA |
| 2049 | 567 | CAUCCAAGUGUCCAAUGUCUU |
| 2050 | 568 | ACCGUCAGCCGCACAGCCCCA |
| 2051 | 569 | CAUUGGACAGCAGAUUGACUA |
| 2052 | 570 | UGUUCACAUCAUUGGACAGCA |
| 2053 | 571 | ACCUGAAUAAAUUCCUAAGUA |
| 2054 | 572 | AUUGGAUUUCUAUCAAAGAAU |
| 2055 | 573 | UUUGUUUGCCCAGUAUGAAAG |
| 2056 | 574 | CAAGGUGCUGUGAGCGGUCUU |
| 2057 | 575 | AACUGGAGGUUGUUCACUUUC |
| 2058 | 576 | GUGCUGUGAGCGGUCUUCUGG |
| 2059 | 577 | CUACUGCACUGAGAGGAUCGU |
| 2060 | 578 | UCCCGAGAACACCCAGGGCUG |
| 2061 | 579 | AACCGAAGACUCUGAGAAGGU |
| 2062 | 580 | AAAUACACAGUUCGAACAAGU |
| 2063 | 581 | UUCUCAGAAUCUUGGAAAUCU |
| 2064 | 582 | AUUCAUCCCUCUGAGGCAGGA |
| 2065 | 583 | ACCUCAAGCAGGGAUGCUGGG |
| 2066 | 584 | GACACAUAGGCAAUUCUUCCA |
| 2067 | 585 | UCAGAGCACAAGCCUUUAUGA |
| 2068 | 586 | ACUAAAUAAGAUUUCCAGUAA |
| 2069 | 587 | AGUUCCUGGAACUGGAGGUUG |
| 2070 | 588 | CAGAGUAGGGCAGUCACUGCA |
| 2071 | 589 | GUCUCUGAUGCCUUAUCCCAA |
| 2072 | 590 | CAUCUUUCAAGGAGGGUCUAG |
| 2073 | 591 | CCAUCUUUCAAGGAGGGUCUA |
| 2074 | 592 | UACUCCUCAGUGAUGAGAACA |
| 2075 | 593 | AACCUGAAUAAAUUCCUAAGU |
| 2076 | 594 | AUUUCUAUCAAAGAAUAUAC |
| 2077 | 595 | CGGUAGCUACAGUUAAACCUG |
| 2078 | 596 | GAAGAAGAGGGUAACCGUCAG |
| 2079 | 597 | UCCAAGGUGCUGUGAGCGGUC |
| 2080 | 598 | UGUUAAAGAAGGCUUCUGUGC |
| 2081 | 599 | ACGCUGACCAGCCCGUGACUU |
| 2082 | 600 | AAGACGAAGUGCCUCAAUUAA |
| 2083 | 601 | AGGACGUAGAAUACCAAUAGA |
| 2084 | 602 | UAUCCUUAUACCAGUUAUAAC |
| 2085 | 603 | GCUGCUGAGACACAUAGGCAA |
| 2086 | 604 | CACCUGAUCAAACUUGUUCAC |
| 2087 | 605 | GAGGUUCGCGUCCUGCAGCGG |
| 2088 | 606 | UGUGAUAUCUCAUCAAGUAGC |
| 2089 | 607 | CACUGUCACCUGAUCAAACUU |
| 2090 | 608 | CUUUCCUCAUUAUCCUUCUUU |
| 2091 | 609 | UCCACUCAGCGUGGUUCCCCG |
| 2092 | 610 | AGAGGUUCGCGUCCUGCAGCG |
| 2093 | 611 | CUUCCGCAUCUACUGCACUGA |
| 2094 | 612 | GUCACAAACACGAUGAUUUUG |
| 2095 | 613 | CCAAUCUUGAAGCACAUAGGC |
| 2096 | 614 | CACUGAAUACAUCAUCUUCUU |
| 2097 | 615 | ACCAGUUAAGAUCUAGCUUCU |

TABLE 5-continued

Results for ABCC4.
Score threshold: 70. Design: siRNA 21 nt.

| SEQ ID NO | siRNA_id | siRNA guide strand/ AS Sequence |
|---|---|---|
| 2098 | 616 | AGGGCAGUCACUGCAAUCGCC |
| 2099 | 617 | AAAUAAGAUUUCCAGUAACAC |
| 2100 | 618 | AGCACGUAGGUGGUGAAGGUC |
| 2101 | 619 | GAAUCUGACUUGCAGCUUUGA |
| 2102 | 620 | GUCAGCAUCUUGAUACACUGC |
| 2103 | 621 | AAGAAUAAUACCGGAGCUUUC |
| 2104 | 622 | AGAUUUCCAGUAACACUUUAU |
| 2105 | 623 | ACAUCAUUGGACAGCAGAUUG |
| 2106 | 624 | UCCUCUAAUCUCCGUUUAUGG |
| 2107 | 625 | AGACCAAACCGAAGACUCUGA |
| 2108 | 626 | CUUCACCUCCUGGUACACGGG |
| 2109 | 627 | UUUGGAGAAACGAUUUAAAAU |
| 2110 | 628 | UCGCGUCCUGCAGCGGGUUGG |
| 2111 | 629 | ACUGCCGAGGAGCACGUAGGU |
| 2112 | 630 | AGGUACGAUUCCUUAGUGUGG |
| 2113 | 631 | CUUGCAACUCCUCUCCAAGGU |
| 2114 | 632 | UCUUUAUCCCAGAACCCUUGC |
| 2115 | 633 | GAAGUGUAAGAACACUGUCAC |
| 2116 | 634 | CUGGAGGUUGUUCACUUUCCU |
| 2117 | 635 | UAUCCCAGAACCCUUGCAACU |
| 2118 | 636 | GGUAGCUACAGUUAAACCUGA |
| 2119 | 637 | AUGUCAGCAUCUUGAUACACU |
| 2120 | 638 | CCAGUUAAGAUCUAGCUUCUC |
| 2121 | 639 | CUCCAAGGUGCUGUGAGCGGU |
| 2122 | 640 | CAGUAACACUUUAUGAUUGCU |
| 2123 | 641 | AUCCAGAGUAGGGCAGUCACU |
| 2124 | 642 | GUGAAGAGUUAACAAGGACGU |
| 2125 | 643 | GGACAGCAGAUUGACUAUCUG |
| 2126 | 644 | GUGAGCAGAGGUUCGCGUCCU |
| 2127 | 645 | CUCUGAGGCAGGAACUUCUCA |
| 2128 | 646 | CAAUUCUUCCAUGCACGCUGA |
| 2129 | 647 | GAAGGUCACAAACACGAUGAU |
| 2130 | 648 | AGGAGAAUGAUUAGAACUGCC |
| 2131 | 649 | CAGGAAGUGUAAGAACACUGU |
| 2132 | 650 | AGAAGAACACGCGUGAGCAGA |
| 2133 | 651 | GAACUGGAGGUUGUUCACUUU |
| 2134 | 652 | CGAAGUGCCUCAAUUAACGUA |
| 2135 | 653 | ACCAUCCUCCAACAGCUGUAA |
| 2136 | 654 | CAUCCGUGAAAGUUGCAGUUU |
| 2137 | 655 | AUCGCCUGCAGUGGUCCUGCC |
| 2138 | 656 | CCGAGGAGCACGUAGGUGGUG |
| 2139 | 657 | CUGCACAUGCACCAUCUUUUU |
| 2140 | 658 | ACUUUGUUUGUUUGCCCAGUA |
| 2141 | 659 | GAUGUCAGCAUCUUGAUACAC |
| 2142 | 660 | GAGGUUGUUCACUUUCCUCAU |
| 2143 | 661 | UUAUCCCAGAACCCUUGCAAC |
| 2144 | 662 | AAUUGGUAAUAAGAUUUGAAA |
| 2145 | 663 | UCCUAUCAGUCAGAUCACC |
| 2146 | 664 | CUGACAGUAAAGGAAAGGCCU |
| 2147 | 665 | CAUCAUUGGACAGCAGAUUGA |
| 2148 | 666 | ACCAAUCUUGAAGCACAUAGG |
| 2149 | 667 | AGAUCUAGCUUCUCGGUUACA |
| 2150 | 668 | UACCCGUGCUUUCUGCCCUCC |
| 2151 | 669 | CUGUCCGCUCGGCUGGAGCCU |
| 2152 | 670 | AAGGUGCUGUGAGCGGUCUUC |
| 2153 | 671 | AAUUCCUAAGUACCAGUUAAG |
| 2154 | 672 | ACUGAAUACAUAUCAUCUUCC |
| 2155 | 673 | GCUCUUGCAAGGUUUACCCGU |
| 2156 | 674 | GAAUACAUAUCAUCUUCCUCU |
| 2157 | 675 | UCUGCCCUCCACUCAGCUGGG |
| 2158 | 676 | UCUUCCUAUUGGAUUUCUAUC |
| 2159 | 677 | UGGACAGCAGAUUGACUAUCU |
| 2160 | 678 | CAAUGUCUUUGGAGAAACGAU |
| 2161 | 679 | UUCCAUGCACGCUGACCAGCC |
| 2162 | 680 | AGAACACCCAGGGCUGCUGAG |
| 2163 | 681 | UGUGAUCUUCUCAUGCAAAAU |
| 2164 | 682 | ACGGGCAGCAUCUUGCCGGGC |
| 2165 | 683 | GAACAAGUGUCUGCUAACUUC |
| 2166 | 684 | UGCCUCUGACACCCUCUCAAU |
| 2167 | 685 | CCAUGCACGCUGACCAGCCCG |
| 2168 | 686 | AAGGAAAGGCCUUGUAGAGUU |
| 2169 | 687 | CACCAUCCUCCAACAGCUGUA |
| 2170 | 688 | CGAACAAGUGUCUGCUAACUU |
| 2171 | 689 | GAAGAGGGUAACCGUCAGCCG |

TABLE 5-continued

Results for ABCC4.
Score threshold: 70. Design: siRNA 21 nt.

| SEQ ID NO | siRNA_id | siRNA guide strand/ AS Sequence |
|---|---|---|
| 2172 | 690 | ACUCCUCUCCAAGGUGCUGUG |
| 2173 | 691 | GAAUCUUGGAAAUCUCCUUCU |
| 2174 | 692 | CAGCGGCAGCAAAUCAUCCAA |
| 2175 | 693 | AAGGGCAGGAGAAUGAUUAGA |
| 2176 | 694 | AUAUCUCAUCAAGUAGCAAAA |
| 2177 | 695 | UUUGCAAGGGCAGGAGAAUGA |
| 2178 | 696 | AAAUCAUCCAAGUGUCCAAUG |
| 2179 | 697 | CGAUAUUCCUAUCUCCAUCCA |
| 2180 | 698 | UAAAUAAGAUUCCAGUAACA |
| 2181 | 699 | CUUGAAGCACAUAGGCAACAU |
| 2182 | 700 | AGGAAAGGCCUUGUAGAGUUG |
| 2183 | 701 | UGCACGCUGACCAGCCCGUGA |
| 2184 | 702 | UCCCUCUGAGGCAGGAACUUC |
| 2185 | 703 | ACACUGCUCUUGCAAGGUUUA |
| 2186 | 704 | CAGGAGAAUGAUUAGAACUGC |
| 2187 | 705 | CACAUAGGCAAUUCUUCCAUG |
| 2188 | 706 | GCAUCUACUGCACUGAGAGGA |
| 2189 | 707 | CACUGCAAUCGCCUGCAGUGG |
| 2190 | 708 | GAACACUGUCACCUGAUCAAA |
| 2191 | 709 | AAGGCUUCUGUGCGUCAUUCU |
| 2192 | 710 | GUGUCCAAUGUCUUUGGAGAA |
| 2193 | 711 | AUCCCAGAACCCUUGCAACUC |
| 2194 | 712 | UCAGAGUUCCCGAGAACACCC |
| 2195 | 713 | CCAAUGUCUUUGGAGAAACGA |
| 2196 | 714 | ACGUCAGCGGCAGCAAAUCAU |
| 2197 | 715 | AGAACGGUAGCUACAGUUAAA |
| 2198 | 716 | GACCAAACCGAAGACUCUGAG |
| 2199 | 717 | GAACACGCGUGAGCAGAGGUU |
| 2200 | 718 | CUCUUGCAAGGUUUACCCGUG |
| 2201 | 719 | CAGUGAUGAACAACUUCCC |
| 2202 | 720 | AACACGCGUGAGCAGAGGUUC |
| 2203 | 721 | GUGAUAUCUCAUCAAGUAGCA |
| 2204 | 722 | GCAGGAACUUCUCAGAAUCUU |
| 2205 | 723 | CUUUAUCCCAGAACCCUUGCA |
| 2206 | 724 | ACCAUCUUUCAAUAUCAGAAU |
| 2207 | 725 | ACCUGAUCAAACUUGUUCACA |
| 2208 | 726 | AAUACCGGAGCUUUCAGAAUU |

TABLE 6

Results for PAK3.
Score threshold: 70. Design: siRNA 21 nt.

| SEQ ID NO | siRNA_id | siRNA guide strand/ AS Sequence |
|---|---|---|
| 2209 | 1 | UAUAUCUCUAUGGAUCACCUG |
| 2210 | 2 | UUAUCUUGCAAGUUCAACCCA |
| 2211 | 3 | UUAGGUAUCAUUAUCUUUGUU |
| 2212 | 4 | UAAUGUAUCUAUUCCUCCUG |
| 2213 | 5 | UAAUUUGUCAACAUUUCUCAA |
| 2214 | 6 | UUUACAAUGACACACACACGA |
| 2215 | 7 | UUCUGUAUUGAGAAUGACCAA |
| 2216 | 8 | AUUAAGGAGAUUAACAACCUG |
| 2217 | 9 | UCUAAUAGUGACAUCUCCCUA |
| 2218 | 10 | UUAAUAUUAAACACAUUCCCA |
| 2219 | 11 | UUACAAUGACACACACACGAG |
| 2220 | 12 | UAAAUAAUCUCUACUGUGCUU |
| 2221 | 13 | UUAACUGAAUAUUAACUGCAA |
| 2222 | 14 | UUCAUUAAUAAUUAAUUCCUU |
| 2223 | 15 | UUCUCUACUAUCGCUGUUGAU |
| 2224 | 16 | ACAACUACUGCAAACAACCUA |
| 2225 | 17 | UUGAGUGCUGAAGAAUCCCGG |
| 2226 | 18 | UAAUAUUAAACACAUUCCCAA |
| 2227 | 19 | AUGAUAUACAGUAAUAUCCUG |
| 2228 | 20 | UAUCUUGCAAGUUCAACCCAA |
| 2229 | 21 | UCAUUCUCUACUAUCGCUGUU |
| 2230 | 22 | UUCAGAACCUGAACUCACCUA |
| 2231 | 23 | UUCCUGAACACACAUAUUCCU |
| 2232 | 24 | UAUACAGACAACAGGAAGCAA |
| 2233 | 25 | UUAUGGGAUAGCAUUUGCCUG |
| 2234 | 26 | UUGCUGUUGAAGGUUCAUCUG |
| 2235 | 27 | UUUACAGAUAACACAUUCUGA |
| 2236 | 28 | UAUAGAAUCUCUCAGAACUGG |
| 2237 | 29 | UUAGAGAAACAACUUUCUGUA |
| 2238 | 30 | UAAGUGUUUAGGUUCACUCUU |
| 2239 | 31 | UGAUAUUAUAGAAUCUCUCAG |
| 2240 | 32 | UUAAUAAUUAAUUCCUUCUUG |
| 2241 | 33 | UAUUAUUAUCAAAUCUUGGUA |
| 2242 | 34 | UACUAUAUCACCUUUCUCUAG |
| 2243 | 35 | UUGAGUUAAAUCUUCUUACAU |
| 2244 | 36 | UAGAAUACUCGUACACACAGG |
| 2245 | 37 | UUUACAUACAGACUGUAUGGA |

TABLE 6-continued

Results for PAK3.
Score threshold: 70. Design: siRNA 21 nt.

| SEQ ID NO | siRNA_id | siRNA guide strand/ AS Sequence |
|---|---|---|
| 2246 | 38 | UAUUAUGAACUUCAUUUGCUU |
| 2247 | 39 | UUUGGUUAGAUGGUCUCCCUU |
| 2248 | 40 | UUUGCAAUACUUUAGGUCCAA |
| 2249 | 41 | UUCUAAUAGUGACAUCUCCCU |
| 2250 | 42 | UUAUAGAAUCUCUCAGAACUG |
| 2251 | 43 | UUUCUUACAGAGUUGAAUGUU |
| 2252 | 44 | UAAGGCUUGCAGUCUUAGCGG |
| 2253 | 45 | UAUAGUUUGCUGAAACUCUAA |
| 2254 | 46 | UUGCCUAGCGUCACAUAGCAA |
| 2255 | 47 | UAACUUAUAGAUAAUAGUCUC |
| 2256 | 48 | UUAUAGAUAAUAGUCUCCUAA |
| 2257 | 49 | AUUAACAGAACUAUAACUGAA |
| 2258 | 50 | UAAAUAAAUAAUCUCUACUGU |
| 2259 | 51 | UAAAUUACAUAAUCUGAGGGA |
| 2260 | 52 | AAGUUGUAUAGAAUACUCGUA |
| 2261 | 53 | UUUAAUAUUAAACACAUUCCC |
| 2262 | 54 | UAGAGAAACAACUUUCUGUAA |
| 2263 | 55 | UAUAAUUAUUUACACGAUCUU |
| 2264 | 56 | UGUAACUAGCAAAUAUCUCUG |
| 2265 | 57 | UAGACAAAUAUCUCAAACUAU |
| 2266 | 58 | AUUUACACGAUCUUUGAGCUG |
| 2267 | 59 | AUAAUUAACAAUAUUAGGGUU |
| 2268 | 60 | UUGUUGACUGUUUCUUUGGAA |
| 2269 | 61 | UUGGGUACUAAAUCUGUUGAA |
| 2270 | 62 | UUAAUUUGUCAACAUUUCUCA |
| 2271 | 63 | UCUACUGUGCUUCUCACCCUU |
| 2272 | 64 | UAUAUUAUUAUCAAAUCUUGG |
| 2273 | 65 | UAAUUUAGGUAUCAUUAUCUU |
| 2274 | 66 | UUACUAUUCAUCCUCAGUGGA |
| 2275 | 67 | UUAAGGAGAUUAACAACCUGG |
| 2276 | 68 | UUUGAGAACAUCUAGAACAGC |
| 2277 | 69 | UACAGAUGAGGAAACAGCCAU |
| 2278 | 70 | UUAAUGUAUCUAUUUCCUCCU |
| 2279 | 71 | UGGAAUAAUUGUAACUAGCAA |
| 2280 | 72 | UUCUAUAACACAAAUUGUUAG |
| 2281 | 73 | UAACUGAAUAUUAACUGCAAG |
| 2282 | 74 | AAGACCAAGAGAUUCAACCGG |
| 2283 | 75 | UUAACAACCUGGUUUACUCAA |
| 2284 | 76 | UUCUCUAUGUUGGUCAGGCUG |
| 2285 | 77 | UAUUUCUGGUUGUUGACUGUU |
| 2286 | 78 | AAUAUUAACUGCAAGUAGCUU |
| 2287 | 79 | UAUUGCUUCAACCACAAUUUA |
| 2288 | 80 | UUUAUUUAGAUAUACAGUUUU |
| 2289 | 81 | UUAACUGCAAGUAGCUUAGAU |
| 2290 | 82 | AUAGAAUUUGAGAACAUCUAG |
| 2291 | 83 | UUUCAUAGGAGAAAUAUUCCA |
| 2292 | 84 | UUGUUUAAUAUUAAACACAUU |
| 2293 | 85 | UUAACUUAUAGAUAAUAGUCU |
| 2294 | 86 | UAUCGCUGUUGAUUUCCUCUU |
| 2295 | 87 | UUACUAUAUCACCUUUCUCUA |
| 2296 | 88 | UAGUGCUUCGUUUACUUUGCU |
| 2297 | 89 | UAUAGCAGGCUGAAUUUGCAA |
| 2298 | 90 | UUUGGAAUCAUAGAAUUUGAG |
| 2299 | 91 | UACUUGAGUUAAAUCUUCUUA |
| 2300 | 92 | UACAUAGUUGUAAUCCCUGUU |
| 2301 | 93 | UACACUAUAUAGUUUGCUGAA |
| 2302 | 94 | AAUCUGUUGAACAUGUUGCCA |
| 2303 | 95 | UUGUCCUGUUGCAAUGUCUAG |
| 2304 | 96 | UAUCUCAGGGCACACUAGCAA |
| 2305 | 97 | UCUAGCAAGUGUGACAGUGUG |
| 2306 | 98 | UAAAGCUCAUAUUAGACUCCG |
| 2307 | 99 | UUAUAUUCUAGCAAGUGUGAC |
| 2308 | 100 | UUACCCAACAUGGUGACUGAU |
| 2309 | 101 | UAUUUCAGUCUUACUCAUGAG |
| 2310 | 102 | UCUCCUGAACAUAAACACGUA |
| 2311 | 103 | UUAGAUGGAUGGAUGUACCUU |
| 2312 | 104 | UUCCUUUGCAGCGAUAAUCAG |
| 2313 | 105 | UAUGACAACGCACUGGAUCCU |
| 2314 | 106 | UUACUUAAUGUCCAACAAGGA |
| 2315 | 107 | UCUCUCUGCAACUUGUAAGUG |
| 2316 | 108 | UAUGCUCUGGUCUUGGUGCGA |
| 2317 | 109 | UUGUAUAGAAUACUCGUACAC |
| 2318 | 110 | UUGCUCUGGAAUUCCAGUGAA |
| 2319 | 111 | UAGAAUUUGAGAACAUCUAGA |

TABLE 6-continued

Results for PAK3.
Score threshold: 70. Design: siRNA 21 nt.

| SEQ ID NO | siRNA_id | siRNA guide strand/ AS Sequence |
|---|---|---|
| 2320 | 112 | UUAUUUGGUACUGCUGGUGAA |
| 2321 | 113 | AUUAUUUACACGAUCUUUGAG |
| 2322 | 114 | UAAUUGCUUCCUUUGCAGCGA |
| 2323 | 115 | AUAAAUUACAUAAUCUGAGGG |
| 2324 | 116 | UUAAACACAUUCCCAAUGCAU |
| 2325 | 117 | UUUCUUAUUCUUCUCUUCAGG |
| 2326 | 118 | AUUUCCUAGGUUCAGAACCUG |
| 2327 | 119 | AUGAGAAACAGCUUCUUUCUA |
| 2328 | 120 | UUCUCCUAUGAGGAUUCCUA |
| 2329 | 121 | UUCUCCUUCUUCUUAUUGGUU |
| 2330 | 122 | UAUCCCACUACAUCUGACUCA |
| 2331 | 123 | UUAGCUUCUCUAAGAUCUCCU |
| 2332 | 124 | UGGAAGUUUGGAGUAAUCGUG |
| 2333 | 125 | UAUAGUUCCCUUUCUGCUGUU |
| 2334 | 126 | UUACAGAUAACACAUUCUGAC |
| 2335 | 127 | UUACUCAUGAGGGAGAUGGUG |
| 2336 | 128 | UCAUCUAGUCCAAUACACUUA |
| 2337 | 129 | UUGUCACUCUUUAUAUCUCUA |
| 2338 | 130 | UUCAGUCUUACUCAUGAGGGA |
| 2339 | 131 | UAUCUGAGGUGACUACCUCAU |
| 2340 | 132 | UAGAACAGCUUGUGGGUUCUU |
| 2341 | 133 | UAUUUAUCCCACUACAUCUGA |
| 2342 | 134 | UAAGAUCUCCUCAUCUGUCAU |
| 2343 | 135 | UAGUCCAAUACACUUAUUUUA |
| 2344 | 136 | UUACAUACAGACUGUAUGGAA |
| 2345 | 137 | UGAGAACAUCUAGAACAGCUU |
| 2346 | 138 | AUAAGUUCUGUUUAGAUUCUU |
| 2347 | 139 | UACUCGAUUGUACCAAAUGUG |
| 2348 | 140 | UAACAUAAAGAAUAAAUACUU |
| 2349 | 141 | UUGUACCAAAUGUGAAUCCUU |
| 2350 | 142 | UCUUAUUCUUCUCUUCAGGGG |
| 2351 | 143 | UUCUCUGCCUACAGUGAUCUG |
| 2352 | 144 | UAUAACACAAAUUGUUAGUUU |
| 2353 | 145 | UUAAGUGACUUGCCUAGCGUC |
| 2354 | 146 | UUUAGGUUCACUCUUAGCAGU |
| 2355 | 147 | UAUUAUUGAACUUCAUUUG |
| 2356 | 148 | AUAGGUACACAAACCAAGCCA |

TABLE 6-continued

Results for PAK3.
Score threshold: 70. Design: siRNA 21 nt.

| SEQ ID NO | siRNA_id | siRNA guide strand/ AS Sequence |
|---|---|---|
| 2357 | 149 | AAGAAUUUCACUACACAUGGU |
| 2358 | 150 | UACAAUGACACACACACGAGA |
| 2359 | 151 | AAGUAUUCCAUGACUACCCAU |
| 2360 | 152 | UAUCUCUAUGGAUCACCUGGU |
| 2361 | 153 | UAAGGAAUUCUGUCGGACUGA |
| 2362 | 154 | AUAUAGUUUGCUGAAACUCUA |
| 2363 | 155 | AUCUAGAACAGCUUGUGGGUU |
| 2364 | 156 | UACUUAAUGUCCAACAAGGAU |
| 2365 | 157 | UUCCUCUUCAUCUUCUUCUUC |
| 2366 | 158 | AACAUCUAGAACAGCUUGUGG |
| 2367 | 159 | UCAUAUAAGGAAUUCUGUCGG |
| 2368 | 160 | UUAGGUCCAAGUUUCAAACUG |
| 2369 | 161 | UUUCUCCUUCUUCUUAUUGGU |
| 2370 | 162 | UUCCUGUACAAAGUACUGGAA |
| 2371 | 163 | AUUAGUAGCUACAGGAUUCUG |
| 2372 | 164 | UAAUGAAUAUGGUAUUUGCGG |
| 2373 | 165 | UUGAGAACAUCUAGAACAGCU |
| 2374 | 166 | AUCUUCUUCUUCUUCUUCCUC |
| 2375 | 167 | UAUUCUACAUUUAUCUGGUUU |
| 2376 | 168 | UGAAACUAAGCAGCAUAUCUG |
| 2377 | 169 | UUCAUAGGAGAAAUAUUCCAU |
| 2378 | 170 | AAGACAUUUAUGAAUAUGCUU |
| 2379 | 171 | UCUAGUGCUGUAUAAACAGUA |
| 2380 | 172 | UAGCCUUCACUGACCUCCCAU |
| 2381 | 173 | UAUUUAACUGCAACAUAAGAG |
| 2382 | 174 | UUUCUAUUCAUUUGAAAGGUA |
| 2383 | 175 | UAGCUUCUCUAAGAUCUCCUC |
| 2384 | 176 | UUAUUAUGAACUUCAUUUGCU |
| 2385 | 177 | UUUACAAAGCUGAAUUUCAG |
| 2386 | 178 | UUAUAAGAAGUUUCUAUUCAU |
| 2387 | 179 | UCAGUAUUCUACAUUUAUCUG |
| 2388 | 180 | UUUAUGGUCACUUCAACAUUG |
| 2389 | 181 | AUUGUUAAUAUGCUGAACUGA |
| 2390 | 182 | UUGCAGUCUUAGCGGCUGCUG |
| 2391 | 183 | AUACAGCUGACAGUCUCUCAG |
| 2392 | 184 | UAAAUACUUGAGUUAAAUCUU |
| 2393 | 185 | UAGUAGCUACAGGAUUCUGUG |

TABLE 6-continued

Results for PAK3.
Score threshold: 70. Design: siRNA 21 nt.

| SEQ ID NO | siRNA_id | siRNA guide strand/ AS Sequence |
|---|---|---|
| 2394 | 186 | CUUGCUAACAACAUUAACGUU |
| 2395 | 187 | AUGGUCACUUCAACAUUGCUG |
| 2396 | 188 | UUCGUUUACUUUGCUCAGGAG |
| 2397 | 189 | UCACAUAAUUCCACCACCCUA |
| 2398 | 190 | AUAUACAGUAAUAUCCUGUUG |
| 2399 | 191 | UAUCACCUUUCUCUAGAUCUU |
| 2400 | 192 | UAUGAACUUCAUUUGCUUGAG |
| 2401 | 193 | UUAGAAAUAUACAUAACUCUC |
| 2402 | 194 | UAUUAUAACAAUAUCAAAUAA |
| 2403 | 195 | UAACUUCUAUUGAAAUUAGUG |
| 2404 | 196 | UUCUUCUUCCUCUUCAUCUUC |
| 2405 | 197 | UUGUCAACAUUUCUCAAUGCU |
| 2406 | 198 | UUCUGCUGUUUAUUUAUUGUA |
| 2407 | 199 | UAGAUGGUCUCCCUUGCUCUU |
| 2408 | 200 | AUACUCUACACACAGGUGUG |
| 2409 | 201 | UUCUUCUUCUUCUUCCUCUUC |
| 2410 | 202 | AUACUUGAGUUAAAUCUUCUU |
| 2411 | 203 | UUGUAACUAGCAAAUAUCUCU |
| 2412 | 204 | UUCACAUAAUUCCACCACCCU |
| 2413 | 205 | UAAAGCUCAUGUAUUUCUGGU |
| 2414 | 206 | UAACUAGCAAAUAUCUCUGCC |
| 2415 | 207 | UAUUGAUUGGGAUGUAGCCUU |
| 2416 | 208 | AUAAUCUCUACUGUGCUUCUC |
| 2417 | 209 | UAAUCGUGCCCAUUGCUCUGG |
| 2418 | 210 | UUAGUAGCUACAGGAUUCUGU |
| 2419 | 211 | AAGGAGAUUAACAACCUGGUU |
| 2420 | 212 | UAAAGAAUAAAUACUUGAGUU |
| 2421 | 213 | UUUAACUGCAACAUAAGAGAC |
| 2422 | 214 | UCUAGGUAUAGGGUCUGCUUU |
| 2423 | 215 | AUGAACACACCAUAUUCCGAA |
| 2424 | 216 | UUGGAGUUCUAAUAGUGACAU |
| 2425 | 217 | AUAGUGACAUCUCCCUAGCUU |
| 2426 | 218 | UCACACAGUACUUGCUCUGGU |
| 2427 | 219 | UUUAGGUACAUUAUCUUUGU |
| 2428 | 220 | UAUUUCUGUAUUGAGAAUGAC |
| 2429 | 221 | UCUAUGACAAUGCAAGUGAA |
| 2430 | 222 | UUCACACAGUACUUGCUCUGG |
| 2431 | 223 | UUCUUCUUCAGACACAGGAGG |
| 2432 | 224 | UCUGUCGGACUGACAUUUCUU |
| 2433 | 225 | UUCUUAUUCUUCUCUUCAGGG |
| 2434 | 226 | AAGGCUUAGAGAAACAACUUU |
| 2435 | 227 | UAAUAUGCUGAACUGAAAGCA |
| 2436 | 228 | UUAAUUGCUUCCUUUGCAGCG |
| 2437 | 229 | UUGUUCAGAGCUCAGAGACUG |
| 2438 | 230 | ACAUCUAGAACAGCUUGUGGG |
| 2439 | 231 | AUCUGUUGAACAUGUUGCCAG |
| 2440 | 232 | AAAUAAAUAAUCUCUACUGUG |
| 2441 | 233 | UUACAACUAAUUUCACAGCUC |
| 2442 | 234 | AUAGAAUACUCGUACACACAG |
| 2443 | 235 | UUACACGAUCUUUGAGCUGAG |
| 2444 | 236 | UAUGGUCACUUCAACAUUGCU |
| 2445 | 237 | UAUUCUAGCAAGUGUGACAGU |
| 2446 | 238 | UAAUAGUCUCCUAAGAAAGCG |
| 2447 | 239 | AACUAAGCAUGAACACACCAU |
| 2448 | 240 | UUUCAUAAGCACAAGAGAGGA |
| 2449 | 241 | UACUUUAGGUCCAAGUUUCAA |
| 2450 | 242 | UAUUAUCAAAUCUUGGUACAA |
| 2451 | 243 | UUUCGCUUCACGGUGGAAGUG |
| 2452 | 244 | UUAUACAGACAACAGGAAGCA |
| 2453 | 245 | UCGGACUGACAUUUCUUGGGA |
| 2454 | 246 | UCUUCUUCUUCAGACACAGGA |
| 2455 | 247 | UAUAUGGUGAAAUAGUAGUCA |
| 2456 | 248 | UUUCUCAAUGCUAAUAGCAUG |
| 2457 | 249 | UUUGUCCAUAUGCAUUUCUUU |
| 2458 | 250 | UUGCUAACAACAUUAACGUUC |
| 2459 | 251 | UCUAUAGUUCCCUUUCUGCUG |
| 2460 | 252 | UAGGUUCAGAACCUGAACUCA |
| 2461 | 253 | UCAUCUUACAUAGUUCUUUUA |
| 2462 | 254 | UUUAUAGACAAAUAUCUCAAA |
| 2463 | 255 | AAACUAAGCAGCAUAUCUGAG |
| 2464 | 256 | ACUCUUAGCAGUCUCAGCCAU |
| 2465 | 257 | AAAGCUUGCAGGCACUCUCUG |
| 2466 | 258 | UUAUGUUGGAAGUUUGGAGUA |
| 2467 | 259 | AUACUUAUUAGAAAUAUACAU |

TABLE 6-continued

Results for PAK3.
Score threshold: 70. Design: siRNA 21 nt.

| SEQ ID NO | siRNA_id | siRNA guide strand/ AS Sequence |
|---|---|---|
| 2468 | 260 | UCUUUGGUGAGUUAGAAGGAA |
| 2469 | 261 | UAGAUAAUAGUCUCCUAAGAA |
| 2470 | 262 | AUCACCUUUCUCUAGAUCUUU |
| 2471 | 263 | UGAAGGAAGAGAGAUCUCUGG |
| 2472 | 264 | UCAUCCAUACAGGUCUCUGUG |
| 2473 | 265 | UACCAAAUGUGAAUCCUUCAG |
| 2474 | 266 | AUUCUGUGAAGAUCUUAUCAU |
| 2475 | 267 | UUCUUAAUUGCUUCCUUUGCA |
| 2476 | 268 | UAAGGAGAUUAACAACCUGGU |
| 2477 | 269 | UGAAUGUACAUAAGUUCUGUU |
| 2478 | 270 | UUUACUAUAUCACCUUUCUCU |
| 2479 | 271 | AUAAUUAUUUACACGAUCUUU |
| 2480 | 272 | UCAUCUGUCAUCUUGGAUUUU |
| 2481 | 273 | AUCAUCUAGUCCAAUACACUU |
| 2482 | 274 | AUAGUCUCCUAAGAAAGCGUG |
| 2483 | 275 | AUCUCCUGAACAUAAACACGU |
| 2484 | 276 | UAAGGGAUGCUAACUAAUGAA |
| 2485 | 277 | ACAACAGGAAGCAAUUUCGUG |
| 2486 | 278 | UGAAAUAGUAGUCAAAUUUUG |
| 2487 | 279 | UAUGUAACUGAUCUCUUUCCC |
| 2488 | 280 | AUUAACAAUAUUAGGGUUCUU |
| 2489 | 281 | UUUACUUUGCUCAGGAGUGAU |
| 2490 | 282 | UUGGUCACUUAAAGGAGUGUG |
| 2491 | 283 | UAUACAGUAAUAUCCUGUUGG |
| 2492 | 284 | UACAGUAAUAUCCUGUUGGAC |
| 2493 | 285 | AAGCACACCACACACAAGCAC |
| 2494 | 286 | AUUAUGAACUUCAUUUGCUUG |
| 2495 | 287 | UAAUUAAUUCCUUCUUGGGUU |
| 2496 | 288 | UAAAUAAUUAACAAUAUUAGG |
| 2497 | 289 | UUCUACAUUUAUCUGGUUUUG |
| 2498 | 290 | UUGCAAUGUCUAGUGCUGUAU |
| 2499 | 291 | UGUGCAUCUUUGAGAAACCUU |
| 2500 | 292 | UACAGCUGACAGUCUCUCAGG |
| 2501 | 293 | UGUAACUGAUCUCUUUCCCU |
| 2502 | 294 | UCAAGUACAGUUAUAUUCUAG |
| 2503 | 295 | UGGACAUCUAAUGACAAUGCA |
| 2504 | 296 | ACUCAUUCUCUACUAUCGCUG |

TABLE 6-continued

Results for PAK3.
Score threshold: 70. Design: siRNA 21 nt.

| SEQ ID NO | siRNA_id | siRNA guide strand/ AS Sequence |
|---|---|---|
| 2505 | 297 | UUGAGAAUUAAACUCUAGAAA |
| 2506 | 298 | UGAAUAGGGCUUCCUAACCAG |
| 2507 | 299 | AUUCUAGCAAGUGUGACAGUG |
| 2508 | 300 | UAAUGAUUUCAAAGUCAGCUU |
| 2509 | 301 | UAGCAAUUUAGUAAUAAAGCU |
| 2510 | 302 | UGACAGUCUCUCAGGAUUCUG |
| 2511 | 303 | AUCGCUGUUGAUUCCUCUUG |
| 2512 | 304 | UGUUCCUGUACAAAGUACUGG |
| 2513 | 305 | UACAAUUCUGAUAAACAAUGA |
| 2514 | 306 | AUAAUUAAUUCCUUCUUGGGU |
| 2515 | 307 | AUUAAUAAUUAAUUCCUUCUU |
| 2516 | 308 | UUCUUCUUCUGUUCCAAUUUU |
| 2517 | 309 | AAGCAGAGGGCAGACAACCUG |
| 2518 | 310 | UUCUCUUCAUUAUCCAGACCG |
| 2519 | 311 | UUCUUUGGUGAGUUAGAAGGA |
| 2520 | 312 | UACAUCUGACUCAUUCUCUAC |
| 2521 | 313 | AAACACAACACUAUGAAGAGG |
| 2522 | 314 | UCUUAAUUGCUUCCUUUGCAG |
| 2523 | 315 | AUUUGAGAACAUCUAGAACAG |
| 2524 | 316 | UCGAACUCCUGACCUCAGGUG |
| 2525 | 317 | UAUGCUCAAAGUCUGAAGGAA |
| 2526 | 318 | UAGUUCAUCACCCACCAAGUA |
| 2527 | 319 | AUUUAUAGACAAAUAUCUCAA |
| 2528 | 320 | UAGAAAUAUACAUAACUCUCC |
| 2529 | 321 | UAGAUGUAAGGAUCAGGUGGU |
| 2530 | 322 | AAUUUAGGUAUCAUUAUCUUU |
| 2531 | 323 | AUAUAUUAUUAUCAAAUCUUG |
| 2532 | 324 | UCUGCAGACAGCUGCUAUCUG |
| 2533 | 325 | UAUCUUUGUUUACUUAAUGUC |
| 2534 | 326 | UAUUCCGAAACAGAAAUAGGU |
| 2535 | 327 | UAUCAUUAUCUUUGUUUACUU |
| 2536 | 328 | UGAACAUAAACACGUACACUA |
| 2537 | 329 | UUGAUUUCCUCUUGGGUACUA |
| 2538 | 330 | UAAACAGUACCUGAUGCCCCU |
| 2539 | 331 | UAGAAGGAAGUUAUCCUUUGG |
| 2540 | 332 | AAUAAUUAACAAUAUUAGGGU |
| 2541 | 333 | UCUUUGUUUACUUAAUGUCCA |

TABLE 6-continued

Results for PAK3.
Score threshold: 70. Design: siRNA 21 nt.

| SEQ ID NO | siRNA_id | siRNA guide strand/ AS Sequence |
|---|---|---|
| 2542 | 334 | UGAACUGAAAGCAUAAGAGAG |
| 2543 | 335 | UAGAUAUAUGGUGAAAUAGUA |
| 2544 | 336 | UAGACAUCACUACCCUGUGAU |
| 2545 | 337 | AUAAAUAAUCUCUACUGUGCU |
| 2546 | 338 | UGCUAUCUGUCCUUCAUCCAU |
| 2547 | 339 | UUAGACAUUGUUUAAUAUUAA |
| 2548 | 340 | UUAUGAACUUCAUUUGCUUGA |
| 2549 | 341 | UUUCAUUAAUAAUUAAUUCCU |
| 2550 | 342 | UAACACAACUGAUUUCAAUUA |
| 2551 | 343 | AUUAGAAAUAUACAUAACUCU |
| 2552 | 344 | UUCAUCUUCUUCUUCAGACAC |
| 2553 | 345 | UUAAUGUCCAACAAGGAUUUC |
| 2554 | 346 | UCUUGGUACAAAGUGGUAGUA |
| 2555 | 347 | UACAGUGAUCUGAAGGGUCAC |
| 2556 | 348 | AUGCAACGCACUGGAUCCUU |
| 2557 | 349 | UUUAACUUAUAGAUAAUAGUC |
| 2558 | 350 | UUGGUACUGCUGGUGAAGCAA |
| 2559 | 351 | UGUUUAUUUAUUGUAAAGCAA |
| 2560 | 352 | UUGCAAGUCAUAACUUCUAUU |
| 2561 | 353 | AACACGUACACUAUAUAGUUU |
| 2562 | 354 | UUCAUAAGCACAAGAGAGGAU |
| 2563 | 355 | AACAACUGUAAAUGAAUUGGA |
| 2564 | 356 | UUCCCAUUUAUUUCCUUCCCA |
| 2565 | 357 | UUGGUGAGUUAGAAGGAAGUU |
| 2566 | 358 | UUUAUUGUAAAGCAAUAUUAU |
| 2567 | 359 | UAAGUAUUUCUGUAUUGAGAA |
| 2568 | 360 | UCUGGUUGUUGACUGUUUCUU |
| 2569 | 361 | AAUUGCAAGUCAUAACUUCUA |
| 2570 | 362 | AGACUUUACAUACAGACUGUA |
| 2571 | 363 | UAACACAAAUUGUUAGUUUUU |
| 2572 | 364 | UGGUUAAACUCAAACAUUGGG |
| 2573 | 365 | UUUCUCUCUGCAACUUGUAAG |
| 2574 | 366 | UAAUAAUUAAUUCCUUCUUGG |
| 2575 | 367 | UACUCGUACACACAGGUGUGC |
| 2576 | 368 | UGAUAUACAGUAAUAUCCUGU |
| 2577 | 369 | UCCUCGCCUAUCCACAUCCAU |
| 2578 | 370 | AUUUGCAAUACUUUAGGUCCA |
| 2579 | 371 | AUAAUCAGAGGAGUCAGGCUG |
| 2580 | 372 | UGUAUCUAUUCCUCCUGGUA |
| 2581 | 373 | UAUAUGGAUGGUUAGAUGGAU |
| 2582 | 374 | UACUAUUCAUCCUCAGUGGAG |
| 2583 | 375 | AUAAGGAAUUCUGUCGGACUG |
| 2584 | 376 | AGAACUAUAACUGAAUGCCAA |
| 2585 | 377 | ACAAGCACACAUUGAACUU |
| 2586 | 378 | UCACCUAGCAGGAUGUCACAG |
| 2587 | 379 | UUUGCAGCGAUAAUCAGAGGA |
| 2588 | 380 | UAACAGAACUAUAACUGAAUG |
| 2589 | 381 | UUGCUCAGGAGUGAUCUGGGC |
| 2590 | 382 | UUGGGAUGUAGCCUUCACUGA |
| 2591 | 383 | AUAUUGAUUGGGAUGUAGCCU |
| 2592 | 384 | UUAUUUAGAUAUACAGUUUUU |
| 2593 | 385 | UGUUGCAAUGCUAGUGCUGU |
| 2594 | 386 | AACAGCUUCUUUCUAAUACUU |
| 2595 | 387 | UAGGUAUCAUUAUCUUUGUUU |
| 2596 | 388 | AUUGUAACUAGCAAAUAUCUC |
| 2597 | 389 | UUAGAAGGAAGUUAUCCUUUG |
| 2598 | 390 | AUUUCUUGGGAUAUGAUUGUA |
| 2599 | 391 | UUGAAGGUUCAUCUGCUUUAU |
| 2600 | 392 | UUAUCCUUUGGUUAGAUGGUC |
| 2601 | 393 | UCUUUAUUUGGUACUGCUGGU |
| 2602 | 394 | UCAUCAAUAAUGAAUAUGGUA |
| 2603 | 395 | UUUCAGUCUUACUCAUGAGGG |
| 2604 | 396 | UUAGAAGCUGUUCUCAUUUGA |
| 2605 | 397 | UCUUCUUCUUCUUCUUCCUCU |
| 2606 | 398 | UUAACAGAACUAUAACUGAAU |
| 2607 | 399 | UAAUAGCAUGUAAUUACUUUU |
| 2608 | 400 | AUAGACAAAUAUCUCAAACUA |
| 2609 | 401 | ACUCUCUGCAGACAGCUGCUA |
| 2610 | 402 | UUAUAUUCAUUUGGUCACUUA |
| 2611 | 403 | UCAGUCAAUUUAACAGAGCCA |
| 2612 | 404 | UUACAUAAUCUGAGGGAGUAG |
| 2613 | 405 | UUUAGAAGCUGUUCUCAUUUG |
| 2614 | 406 | ACUUCUAUUGAAAUUAGUGGG |
| 2615 | 407 | UUAACUGCAACAUAAGAGACU |

TABLE 6-continued

Results for PAK3.
Score threshold: 70. Design: siRNA 21 nt.

| SEQ ID NO | siRNA_id | siRNA guide strand/ AS Sequence |
|---|---|---|
| 2616 | 408 | UUUGUAUCAUAAGUAAAUGAU |
| 2617 | 409 | UCUUCUUCAGACACAGGAGGG |
| 2618 | 410 | UUCACUGACCUCCCAUUUCUU |
| 2619 | 411 | UCCUCUUGGGUACUAAAUCUG |
| 2620 | 412 | AUCCCUCAUCUGUCAUCUUG |
| 2621 | 413 | AAUAAUUAAUUCCUUCUUGGG |
| 2622 | 414 | AUUGUCACUCUUUAUAUCUCU |
| 2623 | 415 | UGUCGGACUGACAUUUCUUGG |
| 2624 | 416 | UGAAUUUGCAAGGCAACCUAU |
| 2625 | 417 | UUUACAUGAAUACAAAUUUAU |
| 2626 | 418 | UAUUAGGGCAUGGACUUCCAC |
| 2627 | 419 | UUUCCCGGCACUAUGAGUGAA |
| 2628 | 420 | UACAUAACUCUCCAAUACAGG |
| 2629 | 421 | ACAAAUAUCUCAAACUAUCAA |
| 2630 | 422 | UAGGUACACAAACCAAGCCAC |
| 2631 | 423 | UUCUGUCGGACUGACAUUUCU |
| 2632 | 424 | UUCAACAUUGCUGCCCUGUUU |
| 2633 | 425 | UGAAGAGGGAGUGUGCAUCUU |
| 2634 | 426 | UGAAACUCUAAAGAAAGUGCU |
| 2635 | 427 | UGUCACUCUUUAUAUCUCUAU |
| 2636 | 428 | UUCAUUUGGUCACUUAAAGGA |
| 2637 | 429 | AAGCUCAUAUUAGACUCCGGG |
| 2638 | 430 | AUACAUAACUCUCCAAUACAG |
| 2639 | 431 | UGUCUAGUGCUGUAUAAACAG |
| 2640 | 432 | UAGUGACAUCUCCCUAGCUUU |
| 2641 | 433 | UUCUAUUGAAAUUAGUGGGAC |
| 2642 | 434 | UUAUUUAUUGUAAAGCAAUAU |
| 2643 | 435 | AUAUGGUGAAAUAGUAGUCAA |
| 2644 | 436 | UGAAGCAAUGGAUUCAACCAC |
| 2645 | 437 | UUGUCCAUAUGCAUUUCUUUU |
| 2646 | 438 | UUCCGAAACAGAAAUAGGUGA |
| 2647 | 439 | AUUAGAAAUAAACCCAUUGAG |
| 2648 | 440 | UAAUUCCUUCUUGGGUUGCUG |
| 2649 | 441 | UGGGAUUAUGACAACGCACUG |
| 2650 | 442 | UUCAUUAUCCAGACCGUCAGA |
| 2651 | 443 | UCUCUUCAUUAUCCAGACCGU |
| 2652 | 444 | UUCUUUGGAAUCAUAGAAUUU |
| 2653 | 445 | AUAUUCUAGCAAGUGUGACAG |
| 2654 | 446 | UACUGCAAAUUAAGAAGCCUU |
| 2655 | 447 | AAAUAAAUUACAUAAUCUGAG |
| 2656 | 448 | AAAGUAUAACAUAGUAUGCUU |
| 2657 | 449 | UGACUCAUUCUCUACUAUCGC |
| 2658 | 450 | AGUACAGUUAUAUUCUAGCAA |
| 2659 | 451 | AACAUUAACGUUCUUUCCUUU |
| 2660 | 452 | UUAUCAUCAAUAAUGAAUAUG |
| 2661 | 453 | UUUAUUUCCUUCCCAGUCCAC |
| 2662 | 454 | UAGCGUCACAUAGCAAUUUAG |
| 2663 | 455 | UACAGGUCUCUGUGACCACAU |
| 2664 | 456 | UUUCCCACUGCCCUAUUCCUA |
| 2665 | 457 | UAUGUAUCCAUGUGCACUUUU |
| 2666 | 458 | UCAGUCUUACUCAUGAGGGAG |
| 2667 | 459 | AUAGGAAAUACACCAGUGGGG |
| 2668 | 460 | AAACAACCUAUAAAUAGGCAG |
| 2669 | 461 | AUCAUUAUCUUUGUUUACUUA |
| 2670 | 462 | UAUAGAAUACUCGUACACACA |
| 2671 | 463 | AAUAGUGACAUCUCCCUAGCU |
| 2672 | 464 | AUCUCUAUGGAUCACCUGGUU |
| 2673 | 465 | UUAACAAUAUUAGGGUUCUUA |
| 2674 | 466 | UCUCUAAGAUCUCCUCAUCUG |
| 2675 | 467 | UCCUCAUCUGUCAUCUUGGAU |
| 2676 | 468 | UUCAUCCAUACAGGUCUCUGU |
| 2677 | 469 | UGAAUGUUUACUAUAUCACCU |
| 2678 | 470 | ACAGAUAACACAUUCUGACAA |
| 2679 | 471 | UUUACACGAUCUUUGAGCUGA |
| 2680 | 472 | AAUACUCGUACACACAGGUGU |
| 2681 | 473 | AAAUCUUGGUACAAAGUGGUA |
| 2682 | 474 | AUAUCUGAGGUGACUACCUCA |
| 2683 | 475 | UCUCUCAUUAGAGCAGUGUGG |
| 2684 | 476 | UUGGAAGUUUGGAGUAAUCGU |
| 2685 | 477 | UUGGUUAGAUGGUCUCCCUUG |
| 2686 | 478 | UUUGAGCUGAGAAAUAUCAUU |
| 2687 | 479 | UUGAUUGGGAUGUAGCCUUCA |
| 2688 | 480 | UGACCUCAGGUGAUCCGCCUG |
| 2689 | 481 | AAUAUUUACAAUGACACACAC |

TABLE 6-continued

Results for PAK3.
Score threshold: 70. Design: siRNA 21 nt.

| SEQ ID NO | siRNA_id | siRNA guide strand/ AS Sequence |
|---|---|---|
| 2690 | 482 | UGGAUUCAACCACAGAACGAG |
| 2691 | 483 | UUUCUGUAUUGAGAAUGACCA |
| 2692 | 484 | UUGUUAAUAUGCUGAACUGAA |
| 2693 | 485 | ACAACUGAUUUCAAUUAUCUG |
| 2694 | 486 | UGCUUAACUGAAUAUUAACUG |
| 2695 | 487 | AUUGCAAGUCAUAACUUCUAU |
| 2696 | 488 | AAUGUUUACUAUAUCACCUUU |
| 2697 | 489 | UGCUUCGUUUACUUUGCUCAG |
| 2698 | 490 | AAAGCUCAUAUUAGACUCCGG |
| 2699 | 491 | UGUCAGUUUACAAAUGCUGAA |
| 2700 | 492 | UGAACUUCAUUUGCUUGAGUU |
| 2701 | 493 | UCCACCACCCUAACACAACUG |
| 2702 | 494 | UAUGGUGAAAUAGUAGUCAAA |
| 2703 | 495 | AAUGAUUUCAAAGUCAGCUUU |
| 2704 | 496 | UCACUCUUGUUGCCGAGGCUG |
| 2705 | 497 | AAGAACGAAGUCAUUACCCAA |
| 2706 | 498 | UUUAAAUGUGGUUUCUCCUAU |
| 2707 | 499 | AACAUAAAGAAUAAAUACUUG |
| 2708 | 500 | AUGCAUUAGUAGCUACAGGAU |
| 2709 | 501 | UCGCCUAUCCACAUCCAUCUC |
| 2710 | 502 | AAUGUAUCUAUUUCCUCCUGG |
| 2711 | 503 | UAUUGUCACUCUUUAUAUCUC |
| 2712 | 504 | UAUUCAUCCUCAGUGGAGGAG |
| 2713 | 505 | UGAGUGCUGAAGAAUCCCGGU |
| 2714 | 506 | UGACUUCUCUAGGUAUAGGGU |
| 2715 | 507 | UCAUUGGUCACUUAAAGGAG |
| 2716 | 508 | UUAUCUUUGUUUACUUAAUGU |
| 2717 | 509 | AUAUUAUUAUCAAAUCUUGGU |
| 2718 | 510 | UAAGCAUGAACACACCAUAUU |
| 2719 | 511 | AUGAAUAUGGUAUUUGCGGGU |
| 2720 | 512 | UUAUUGUAAAGCAAUAUUAUA |
| 2721 | 513 | UGUUUCUUUGGAAUCUAGAA |
| 2722 | 514 | UACUCUCAGAAGAUUCAGGAA |
| 2723 | 515 | UCCUGAACACACAUAUUCCUC |
| 2724 | 516 | AUGGAUUCAACCACAGAACGA |
| 2725 | 517 | UGCAAGAGGGACUACUCUCUA |
| 2726 | 518 | UUCCUAACUCAGGACAUUUUG |

TABLE 6-continued

Results for PAK3.
Score threshold: 70. Design: siRNA 21 nt.

| SEQ ID NO | siRNA_id | siRNA guide strand/ AS Sequence |
|---|---|---|
| 2727 | 519 | UAUAACAUAGUAUGCUUCAAA |
| 2728 | 520 | AAUUUCAGUCCUCUUGUUCAG |
| 2729 | 521 | UUAGUAAUAAAGCUCAUAUUA |
| 2730 | 522 | UCACUCUUUAUAUCUCUAUGG |
| 2731 | 523 | UUUCUCUAUGUUGGUCAGGCU |
| 2732 | 524 | UAUUAAGGAGAUUAACAACCU |
| 2733 | 525 | UCGCUGUUGAUUUCCUCUUGG |
| 2734 | 526 | UAUGUUGGAAGUUUGGAGUAA |
| 2735 | 527 | UACCUGAAUGAUAUACAGUAA |
| 2736 | 528 | UACACUCAAGACACAGUCAUG |
| 2737 | 529 | UCUCUGCCUACAGUGAUCUGA |
| 2738 | 530 | UUGGGUUAUAUUCAUUUGGUC |
| 2739 | 531 | UAGGUAUAGGGUCUGCUUUUA |
| 2740 | 532 | UUCAAAUUAAUAUUACCGUUU |
| 2741 | 533 | UAUAUAGUUUGCUGAAACUCU |
| 2742 | 534 | UAGUCUCCUAAGAAAGCGUGU |
| 2743 | 535 | AAUCGUAUGCUCAAAGUCUGA |
| 2744 | 536 | AUCAGAAAUGCUAUCUUUGGU |
| 2745 | 537 | UAGAAGCUGUUCUCAUUUGAA |
| 2746 | 538 | UUUAGUAAUAAAGCUCAUAUU |
| 2747 | 539 | AAACACGUACACUAUAUAGUU |
| 2748 | 540 | AAUGCUUCUUAGCUUCUCUAA |
| 2749 | 541 | UAUUGAAAUUAGUGGGACUUG |
| 2750 | 542 | AUUGGAUAGACUCACCUGUG |
| 2751 | 543 | UAUCUAAAUAAUUAACAAUAU |
| 2752 | 544 | UUUCCUAGGUUCAGAACCUGA |
| 2753 | 545 | AUAAUGAAUAUGGUAUUUGCG |
| 2754 | 546 | UAAGAAGUUUCUAUUCAUUUG |
| 2755 | 547 | UAAAGCAAUAUUAUAACAAUA |
| 2756 | 548 | AACAGGAAGCAAUUUCGUGUU |
| 2757 | 549 | UUCACUCUUGUUGCCGAGGCU |
| 2758 | 550 | UUAAUGAUUUCAAAGUCAGCU |
| 2759 | 551 | UAAGCAGCAUAUCUGAGGUGA |
| 2760 | 552 | UAUGGGAUAGCAUUUGCCUGA |
| 2761 | 553 | UCUCAGAGAAAGUCCCAUCUU |
| 2762 | 554 | UUGCAGAUUCAGUUAGACAUU |
| 2763 | 555 | UAGCAAUGGAAUGUGCUUCAC |

TABLE 6-continued

Results for PAK3.
Score threshold: 70. Design: siRNA 21 nt.

| SEQ ID NO | siRNA_id | siRNA guide strand/ AS Sequence |
|---|---|---|
| 2764 | 556 | UCCAUUAUUUCCAAGUUCCCA |
| 2765 | 557 | UUCACAGGAAAGGAGAAGCUC |
| 2766 | 558 | UGACUGUUUCUUUGGAAUCAU |
| 2767 | 559 | UAUGUUUCAUAAGCACAAGAG |
| 2768 | 560 | AGUAGCUUAGAUAAAGACCAA |
| 2769 | 561 | UGUGCUUCUCACCCUUCCCUG |
| 2770 | 562 | UUUAUCUUGCAAGUUCAACCC |
| 2771 | 563 | AAAUAAUUAACAAUAUUAGGG |
| 2772 | 564 | UCCACAUCCAUCUCAAGACAG |
| 2773 | 565 | ACACAGUCAUGCACAAUCCAU |
| 2774 | 566 | AUUAAUUUGUCAACAUUUCUC |
| 2775 | 567 | UCUGAAGGGUCACUGCUCCAA |
| 2776 | 568 | AACAGCUUGUGGGUUCUUCUU |
| 2777 | 569 | UAGGAAAUACACCAGUGGGGU |
| 2778 | 570 | AUAUUAUAGAAUCUCUCAGAA |
| 2779 | 571 | UGAGAAACAGCUUCUUUCUAA |
| 2780 | 572 | UGGGAUUACAGGUAUGAGCCA |
| 2781 | 573 | UUAGGUUCACUCUUAGCAGUC |
| 2782 | 574 | UGCUGUAUAAACAGUACCUGA |
| 2783 | 575 | UAGAUGGAUGGAUGUACCUUG |
| 2784 | 576 | UCUUCUUCUGUAUUCCAAUUUUG |
| 2785 | 577 | UGGUCUCGAACUCCUGACCUC |
| 2786 | 578 | UAAUCCAAAGUUACAGAAGAA |
| 2787 | 579 | AUAUUAACUGCAAGUAGCUUA |
| 2788 | 580 | AAGGAUUUCAGUAUUCUACAU |
| 2789 | 581 | UUGAGCUGAGAAAUAUCAUUU |
| 2790 | 582 | UGGAGCUGUGGUUGAGUGCUG |
| 2791 | 583 | UUCCUAACCAGGUAUUGGGCU |
| 2792 | 584 | AUCAUCAAUAAUGAAUAUGGU |
| 2793 | 585 | AGAACAUCUAGAACAGCUUGU |
| 2794 | 586 | UACCUCAUUAUUAAAGUUCUC |
| 2795 | 587 | UCAUUUAUAGACAAAUAUCUC |
| 2796 | 588 | AAUAAACUGUUAACAAUCUGG |
| 2797 | 589 | UACUGCUGGUGAAGCAAUGGA |
| 2798 | 590 | UCUCCUAUGAGGAUUUCCUAG |
| 2799 | 591 | UAACUCUCCAAUACAGGGAAG |
| 2800 | 592 | ACAAUUCUGAUAAACAAUGAA |

TABLE 6-continued

Results for PAK3.
Score threshold: 70. Design: siRNA 21 nt.

| SEQ ID NO | siRNA_id | siRNA guide strand/ AS Sequence |
|---|---|---|
| 2801 | 593 | UAUUAGAAAUAUACAUAACUC |
| 2802 | 594 | AUAGAUGUAAGGAUCAGGUGG |
| 2803 | 595 | UGUAUUUCUGGUUGUUGACUG |
| 2804 | 596 | AUGGUGACUGAUUUGAGGGGA |
| 2805 | 597 | AAUGAAUAUGGUAUUUGCGGG |
| 2806 | 598 | ACUCUUUAUAUCUCUAUGGAU |
| 2807 | 599 | UUCCAGCAGUGUACUCAUCAU |
| 2808 | 600 | UUGUAUCAUAAGUAAAUGAUG |
| 2809 | 601 | UAAUCUCUACUGUGCUUCUCA |
| 2810 | 602 | AUGUUCACACAGUACUUGCUC |
| 2811 | 603 | UUUGAGUGCAGGAAAUCCAAA |
| 2812 | 604 | AAUGGAAUGUGCUUCACCGGG |
| 2813 | 605 | UCUCUCAGGAUUCUGGAGCUC |
| 2814 | 606 | AAACUCUAAAGAAAGUGCUUU |
| 2815 | 607 | UCUUGGGUACUAAAUCUGUUG |
| 2816 | 608 | AAUUAAACUCUAGAAAGCCCA |
| 2817 | 609 | AUAUUUACAAUGACACACACA |
| 2818 | 610 | UUCUUCCUCUUCAUCUUCUUC |
| 2819 | 611 | UAUCUCCGAUGUAAAGCUCA |
| 2820 | 612 | UUUGCUGAAACUCUAAAGAAA |
| 2821 | 613 | UUGGUGCGAUAACUGGUGGUG |
| 2822 | 614 | UAAUUAUUUACACGAUCUUUG |
| 2823 | 615 | UAUUUCCUCCUGGUAUGCCUA |
| 2824 | 616 | ACAAAUAAAUUACAUAAUCUG |
| 2825 | 617 | AUUUACAUGAAUACAAAUUUA |
| 2826 | 618 | UACACAGACACUCCGCAGAUA |
| 2827 | 619 | UGGGUUCUUCUUCUGUUCCAA |
| 2828 | 620 | UGGAUCCUUGCUAACAACAUU |
| 2829 | 621 | UCUCUGCAACUUGUAAGUGUU |
| 2830 | 622 | UACAUGAAUACAAAUUUAUAA |
| 2831 | 623 | UCAAGUUACUCGAUUGUACCA |
| 2832 | 624 | UCUGUGACCACAUCAGUCAGA |
| 2833 | 625 | AUAACUCUCCAAUACAGGGAA |
| 2834 | 626 | UUCACUACACAUGGUUUACAG |
| 2835 | 627 | UAACUGCAACAUAAGAGACUC |
| 2836 | 628 | AACUGAUUUCAAUUAUCUGUG |
| 2837 | 629 | UGCUGUUCUUAAUUGCUUCCU |

TABLE 6-continued

Results for PAK3.
Score threshold: 70. Design: siRNA 21 nt.

| SEQ ID NO | siRNA_id | siRNA guide strand/ AS Sequence |
|---|---|---|
| 2838 | 630 | UCUCAAUGCUAAUAGCAUGUA |
| 2839 | 631 | AUUUACAAUGACACACACACG |
| 2840 | 632 | AUACAGUAAUAUCCUGUUGGA |
| 2841 | 633 | AUGAGGAUUUCCUAGGUUCAG |
| 2842 | 634 | AACUUCUAUUGAAAUUAGUGG |
| 2843 | 635 | UGCAUCUUUGAGAAACCUUUU |
| 2844 | 636 | UCAGAAAUGCUAUCUUUGGUU |
| 2845 | 637 | AUCUGCAACAGAUGUUAUCAA |
| 2846 | 638 | AUUGCAACUCUAUUAGGGCAU |
| 2847 | 639 | UGUAAAGCUCAUGUAUUUCUG |
| 2848 | 640 | AGAUUUGGAUAGACUCACCUG |
| 2849 | 641 | UUCCACCAUUUCAAUUGCCAU |
| 2850 | 642 | UUACUCGAUUGUACCAAAUGU |
| 2851 | 643 | UUUGCUCAGGAGUGAUCUGGG |
| 2852 | 644 | UAACAUAGUAUGCUUCAAAUU |
| 2853 | 645 | UCAAAUCUUGGUACAAAGUGG |
| 2854 | 646 | AAUCUUGGUACAAAGUGGUAG |
| 2855 | 647 | UUCCUUCUUGGGUUGCUGUUG |
| 2856 | 648 | GAGAACAUCUAGAACAGCUUG |
| 2857 | 649 | AUUAUUAAAGUUCUCACCUAA |
| 2858 | 650 | AAGGCUUGCAGUCUUAGCGGC |
| 2859 | 651 | UGCAUUAGUAGCUACAGGAUU |
| 2860 | 652 | AGAAUUUCACUACACAUGGUU |
| 2861 | 653 | UUGUAAUCCCUGUUUAUGUUA |
| 2862 | 654 | UGGUUGUUGACUGUUUCUUUG |
| 2863 | 655 | UUAGAUGGUCUCCCUUGCUCU |
| 2864 | 656 | UCUGGAGCUCUGGAGUUCCAU |
| 2865 | 657 | ACUCACAAUGCUUCUUAGCUU |
| 2866 | 658 | AUAACUUCUAUUGAAAUUAGU |
| 2867 | 659 | UCAACAUUGAAAGAUGUGCCC |
| 2868 | 660 | UCAUCACCCACCAAGUAGCUA |
| 2869 | 661 | AAGUCAGUCAAUUUAACAGAG |
| 2870 | 662 | UAGGGCAUGGACUUCCACAUG |
| 2871 | 663 | AUCUCAGCUCACCACAACCUC |
| 2872 | 664 | AUGUUAUGAGUAUAAUCCCAG |
| 2873 | 665 | UUUCAUUGAAUUUCCCGGCAC |
| 2874 | 666 | UAUUCCAUUAUUUCCAAGUUC |
| 2875 | 667 | AAGAAUAUUGUCACUCUUUAU |
| 2876 | 668 | AGAAAUAUACAUAACUCUCCA |
| 2877 | 669 | UUACAGAAGAAUUUCACUACA |
| 2878 | 670 | UAUAAUCCCAGUAGACAUCAC |
| 2879 | 671 | UUUGUCAACAUUUCUCAAUGC |
| 2880 | 672 | UGGUCUUGGUGCGAUAACUGG |
| 2881 | 673 | AAGUAAAUGAUGAUUAAUGUA |
| 2882 | 674 | UACUUAUUAGAAAUAUACAUA |
| 2883 | 675 | AUAUCUCUAUGGAUCACCUGG |
| 2884 | 676 | UUGACUGUUUCUUUGGAAUCA |
| 2885 | 677 | UCUGUAUUGAGAAUGACCAAU |
| 2886 | 678 | UUCAACCUGAGAGUCUGUUAA |
| 2887 | 679 | UUGUUUAAUGAUUUCAAAGUC |
| 2888 | 680 | AUUCCGAAACAGAAAUAGGUG |
| 2889 | 681 | ACUAAAUCUGUUGAACAUGUU |
| 2890 | 682 | UAAUCAGAGGAGUCAGGCUGG |
| 2891 | 683 | AAGUAUAACAUAGUAUGCUUC |
| 2892 | 684 | UACACGAUCUUUGAGCUGAGA |
| 2893 | 685 | AAAUGCUGAAUUUCAGUCCUC |
| 2894 | 686 | CUAAGCAGCAUAUCUGAGGUG |
| 2895 | 687 | UUCUAUUCAUUUGAAAGGUAA |
| 2896 | 688 | UUUGCAGAUUCAGUUAGACAU |
| 2897 | 689 | UAGCUUUAACUUUAUAGAUAAU |
| 2898 | 690 | UAAUCCCAGUAGACAUCACUA |
| 2899 | 691 | UAUAUUCAUUUGGUCACUUAA |
| 2900 | 692 | UAGUAAUAAAGCUCAUAUUAG |
| 2901 | 693 | UUCUCUAGGUAUAGGGUCUGC |
| 2902 | 694 | UCAAUGCAUUAGUAGCUACAG |
| 2903 | 695 | GUGCUGUAUAAACAGUACCUG |
| 2904 | 696 | AAUAUGCUGAACUGAAAGCAU |
| 2905 | 697 | UAAUAAAUAGAUAUAUGGUGA |
| 2906 | 698 | AUUAAACUCUAGAAAGCCCAG |
| 2907 | 699 | AUCUGACUCAUUCUCUACUAU |
| 2908 | 700 | AGACAGCUGCUAUCUGUCCUU |
| 2909 | 701 | AAUUCUGUCGGACUGACAUUU |
| 2910 | 702 | UAUUUGUUUAAUGAUUUCAAA |
| 2911 | 703 | UGUCAACAUUUCUCAAUGCUA |

TABLE 6-continued

Results for PAK3.
Score threshold: 70. Design: siRNA 21 nt.

| SEQ ID NO | siRNA_id | siRNA guide strand/ AS Sequence |
|---|---|---|
| 2912 | 704 | UAGUUUGCUGAAACUCUAAAG |
| 2913 | 705 | UGUUUCAUAAGCACAAGAGAG |
| 2914 | 706 | AUGUGACAGGAUUUCACCGUU |
| 2915 | 707 | AUACUGCAAAUUAAGAAGCCU |
| 2916 | 708 | UAAUUGCAAGUCAUAACUUCU |
| 2917 | 709 | UUAUCCAGACCGUCAGACAUU |
| 2918 | 710 | UUUAUUGGUACUGCUGGUGA |
| 2919 | 711 | AAUUGCUUCCUUUGCAGCGAU |
| 2920 | 712 | UAAGUGACUUGCCUAGCGUCA |
| 2921 | 713 | AUCAAAUCUUGGUACAAAGUG |
| 2922 | 714 | UCAUGGGAUUAUGACAACGCA |
| 2923 | 715 | UACAGUUAUAUUCUAGCAAGU |
| 2924 | 716 | ACAAGUUGUAUAGAAUACUCG |
| 2925 | 717 | AGAAUUUGAGAACAUCUAGAA |
| 2926 | 718 | UUCAGUUAGACAUUGUUUAAU |
| 2927 | 719 | UAAAUGAUGAUUAAUGUAUCU |
| 2928 | 720 | AAUGAUAUACAGUAAUAUCCU |
| 2929 | 721 | AAGUCAUUACCCAACAUGGUG |
| 2930 | 722 | UCUUCUUCUUCUUCCUCUUCA |
| 2931 | 723 | UAUUAACUGCAAGUAGCUUAG |
| 2932 | 724 | UGGUAGUAAAGAAGUACCUGG |
| 2933 | 725 | UAAGUUCUGUUUAGAUUCUUU |
| 2934 | 726 | UAUAAGAAGUUUCUAUUCAUU |
| 2935 | 727 | ACAACAUUAACGUUCUUUCCU |
| 2936 | 728 | UUCAAGACAUUUAUGAAUAUG |
| 2937 | 729 | ACAACUGUAAAUGAAUUGGAA |
| 2938 | 730 | AUUGUUUAAUAUUAAACACAU |
| 2939 | 731 | UAAAUCUGUUGAACAUGUUGC |
| 2940 | 732 | AACAUUGCUGCCCUGUUUGGG |
| 2941 | 733 | UUUCUUUGGAAUCAUAGAAUU |
| 2942 | 734 | UGAGUUCACUUCAAAUCCCAG |
| 2943 | 735 | UAAACGUUAUAAAUUGUCAAA |
| 2944 | 736 | UAGGGCUUCCUAACCAGGUAU |
| 2945 | 737 | UGUAAAGCAAUAUUAUAACAA |
| 2946 | 738 | UUAAAUGUGGUUUCUCCUAUG |
| 2947 | 739 | UCUUGGUGCGAUAACUGGUGG |
| 2948 | 740 | UCAGAACCUGAACUCACCUAG |
| 2949 | 741 | UUUCUUGGGAUAUGAUUGUAA |
| 2950 | 742 | UUAAUAUUACCGUUUCAUUUU |
| 2951 | 743 | UGAGCUGAGAAAUAUCAUUUA |
| 2952 | 744 | UUGUGGGUUCUUCUUCUGUUC |
| 2953 | 745 | UUGAGCUUUAUUUAGAUAUAC |
| 2954 | 746 | AGACCAGAUAUCAACUUUCGG |
| 2955 | 747 | GAAAUAUACAUAACUCUCCAA |
| 2956 | 748 | AAGAUUUGGAUAGACUCACCU |
| 2957 | 749 | UCUACUAUCGCUGUUGAUUUC |
| 2958 | 750 | AUGGUUUACAGAUAACACAUU |
| 2959 | 751 | UAUCAUAAGUAAAUGAUGAUU |
| 2960 | 752 | AUAAAGCACACCACACACAAG |
| 2961 | 753 | UCAGCUCACCACAACCUCCGC |
| 2962 | 754 | AAUAGUCUCCUAAGAAAGCGU |
| 2963 | 755 | UACAGAGUUGAAUGUUUACUA |
| 2964 | 756 | UUCCUAGGUUCAGAACCUGAA |
| 2965 | 757 | UUUGGUCACUUAAAGGAGUGU |
| 2966 | 758 | AAAGGCUUAGAGAAACAACUU |
| 2967 | 759 | AAAUUAGGGGACUUGCCCUA |
| 2968 | 760 | AAAUUACAUAAUCUGAGGGAG |
| 2969 | 761 | AUUGCUUCAACCACAAUUUAA |
| 2970 | 762 | UACAAGUUGUAUAGAAUACUC |
| 2971 | 763 | UAAUUAACAAUAUUAGGGUUC |
| 2972 | 764 | AACAUAAACACGUACACUAUA |
| 2973 | 765 | AACUUUCGGACCAUAAGCUUU |
| 2974 | 766 | UUAUGAGUAUAAUCCCAGUAG |
| 2975 | 767 | UCUCAGAAGAUUCAGGAAGUG |
| 2976 | 768 | UGAUUAAUGUAUCUAUUUCCU |
| 2977 | 769 | AAUCAUAGAAUUUGAGAACAU |
| 2978 | 770 | ACAGCUGACAGUCUCUCAGGA |
| 2979 | 771 | UCAUCCUCAGUGGAGGAGCCG |
| 2980 | 772 | ACUAGCAACAUCAAAGAUUUG |
| 2981 | 773 | UAGCAACAUCAAAGAUUUGGA |
| 2982 | 774 | CAGUAUUCUACAUUUAUCUGG |
| 2983 | 775 | AACACACAUAUUCCUCUCCAC |
| 2984 | 776 | UUAAACUCUAGAAAGCCCAGC |
| 2985 | 777 | AACACAACUGAUUUCAAUUAU |

TABLE 6-continued

Results for PAK3.
Score threshold: 70. Design: siRNA 21 nt.

| SEQ ID NO | siRNA_id | siRNA guide strand/ AS Sequence |
|---|---|---|
| 2986 | 778 | UAGAAAUAAACCCAUUGAGCA |
| 2987 | 779 | UACAGAUAACACAUUCUGACA |
| 2988 | 780 | UUGGAGCUGUGGUUGAGUGCU |
| 2989 | 781 | AACGAGUAUAGAUUGAUUUUG |
| 2990 | 782 | UGAUCUGGGCACAGAACCCAA |
| 2991 | 783 | AUGGAGACCAUCCCAAGCCAA |
| 2992 | 784 | AGUUAGAAGGAAGUUAUCCUU |
| 2993 | 785 | CUUAUAGAUAAUAGUCUCCUA |
| 2994 | 786 | UACCUUUGCUUAACUGAAUAU |
| 2995 | 787 | UUCUCUAAGAUCUCCUCAUCU |
| 2996 | 788 | UCAAGCACAGUCAUGCACAA |
| 2997 | 789 | AUGACACACACGAGAUCAG |
| 2998 | 790 | UGGAAUUCCAGUGAAUUCCCC |
| 2999 | 791 | UCUCUCUCUCAUUAGAGCAGU |
| 3000 | 792 | UGAAUCCUUCAGCAUCACUGU |
| 3001 | 793 | AUUAACUGCAAGUAGCUUAGA |
| 3002 | 794 | UUCCAAGAGACCAGAUAUCAA |
| 3003 | 795 | AUAAUUGUAACUAGCAAAUAU |
| 3004 | 796 | UUCAGAGCUCAGAGACUGGGA |
| 3005 | 797 | UUAUCCCACUACAUCUGACUC |
| 3006 | 798 | AAUAAAUAGAUAUAUGGUGAA |
| 3007 | 799 | UCUCAGUUCCCGCAUUUGCAG |
| 3008 | 800 | UUACAAAUGCUGAAUUUCAGU |
| 3009 | 801 | UGUAAAUGAAUUGGAAGGCUG |
| 3010 | 802 | UAGGUUCACUCUUAGCAGUCU |
| 3011 | 803 | UUACCCUCUUUCCAGCAGUGU |
| 3012 | 804 | UGUUGAAGGUUCAUCUGCUUU |
| 3013 | 805 | UUUCAGUCCUCUUGUUCAGAG |
| 3014 | 806 | UCUUUGGAAUCAUAGAAUUUG |
| 3015 | 807 | UAACUCCCAGUUUACCCUCUU |
| 3016 | 808 | UCUCCUUCUUCUUAUUGGUUU |
| 3017 | 809 | UAGGCUAGUAUUUAUCCCACU |
| 3018 | 810 | UUAUCUCAGGGCACACUAGCA |
| 3019 | 811 | AAAUACUUGAGUUAAAUCUUC |
| 3020 | 812 | AGUUAUAUUCUAGCAAGUGUG |
| 3021 | 813 | UAAACCCAUUGAGCAAAGGAA |
| 3022 | 814 | UACUAUCGCUGUUGAUUUCCU |
| 3023 | 815 | AAUACAGCUGACAGUCUCUCA |
| 3024 | 816 | UCUUUCUCCUUCUUCUUAUUG |
| 3025 | 817 | UCAACUUUCGGACCAUAAGCU |
| 3026 | 818 | UUGAGCAAAGGAAUAUAAUUA |
| 3027 | 819 | UUGAAAGAUGUGCCCUCGUUA |
| 3028 | 820 | AUUUCUCUCUGCAACUUGUAA |
| 3029 | 821 | UGAAAGAAAUCUGAAUAACAU |
| 3030 | 822 | UCUUUCUAAUACUUAUUAGAA |
| 3031 | 823 | AACUGCAACAUAAGAGACUCA |
| 3032 | 824 | UUAAUUUAGGUAUCAUUAUCU |
| 3033 | 825 | AGAAAUAUCAUUUAUAGACAA |
| 3034 | 826 | CAUAUAAGGAAUUCUGUCGGA |
| 3035 | 827 | AAGUGUUUAGGUUCACUCUUA |
| 3036 | 828 | UGAUCUGAAGGGUCACUGCUC |
| 3037 | 829 | UGACCUCUUUAUUGGUACUG |
| 3038 | 830 | UACUCGAAGGAUGGGCUGCUA |
| 3039 | 831 | AUUAACAACCUGGUUUACUCA |
| 3040 | 832 | UGAGUUAAAUCUUCUUACAUG |
| 3041 | 833 | AUUCCUUCUUGGGUUGCUGUU |
| 3042 | 834 | AAUGCAUUAGUAGCUACAGGA |
| 3043 | 835 | ACUAGCAAAUAUCUCUGCCCU |
| 3044 | 836 | UGUGACAGGAUUUCACCGUUU |
| 3045 | 837 | AACACAUUCCCAAUGCAUGUU |
| 3046 | 838 | AAUAAUUUGUAUCAUAAGUAA |
| 3047 | 839 | AUUAUUAUGAACUUCAUUUGC |
| 3048 | 840 | UAUGCUGAACUGAAAGCAUAA |
| 3049 | 841 | AUAAACACGUACACUAUAUAG |
| 3050 | 842 | UUACUGCUGGUAUUAUGGGAU |
| 3051 | 843 | AUCUAGUCCAAUACACUUAUU |
| 3052 | 844 | UCUUAGCUUCUCUAAGAUCUC |
| 3053 | 845 | UGCUGAAUUUCAGUCCUCUUG |
| 3054 | 846 | ACUAUCGCUGUUGAUUUCCUC |
| 3055 | 847 | ACACAUAUUCCUCUCCACUUU |
| 3056 | 848 | UUCUUUCUAAUACUUAUUAGA |
| 3057 | 849 | UGGAAUGUGCUUCACCGGGGA |
| 3058 | 850 | UCAUUGAUGUUUGUCAUUUUU |
| 3059 | 851 | AAAUGAUGAUUAAUGUAUCUA |

TABLE 6-continued

Results for PAK3.
Score threshold: 70. Design: siRNA 21 nt.

| SEQ ID NO | siRNA_id | siRNA guide strand/ AS Sequence |
|---|---|---|
| 3060 | 852 | AAUUUGUCAACAUUUCUCAAU |
| 3061 | 853 | UUCAGUAUUCUACAUUUAUCU |
| 3062 | 854 | UCUAGUCCAAUACACUUAUUU |
| 3063 | 855 | ACAACUUUCUGUAAUUUACAA |
| 3064 | 856 | UUCUGGUUGUUGACUGUUUCU |
| 3065 | 857 | UUCUGUGAAGAUCUUAUCAUC |
| 3066 | 858 | UUAAUUCCUUCUUGGGUUGCU |
| 3067 | 859 | AUCUCUGCCCUGCAUGCUCUG |
| 3068 | 860 | UGUGGUUUCUCCUAUGAGGAU |
| 3069 | 861 | AUGUAACUGAUCUCUUUCCCC |
| 3070 | 862 | UACAGAAGAAUUUCACUACAC |
| 3071 | 863 | UUAAGAAGCCUUCUAUAACAC |
| 3072 | 864 | AAAUGCUAUCUUUGGUUCCCA |
| 3073 | 865 | UAAGAAGCCUUCUAUAACACA |
| 3074 | 866 | UUUGGAGUAAUCGUGCCCAUU |
| 3075 | 867 | AUUAAGGCCUCUCUCUCUCAU |
| 3076 | 868 | AUUUGAAAGGUAAAGAACCCC |
| 3077 | 869 | UUUGUUUAAAUGUGGUUUCUC |
| 3078 | 870 | UAUCAGAUACAAUGCCCUGAG |
| 3079 | 871 | UUUGGUACUGCUGGUGAAGCA |
| 3080 | 872 | AACACAACACUAUGAAGAGGG |
| 3081 | 873 | UUUCAAGACAUUUAUGAAUAU |
| 3082 | 874 | UGGAUCCUUCUCAACUUGUUU |
| 3083 | 875 | UAUAACAGUACCUGAUGCCC |
| 3084 | 876 | UAGCAGGAUGUCACAGUUUCA |
| 3085 | 877 | AAAUCUGUUGAACAUGUUGCC |
| 3086 | 878 | UUCAACCACAGAACGAGUAUA |
| 3087 | 879 | AUGUACAUAAGUUCUGUUUAG |
| 3088 | 880 | UCUGAAGGAAGAGAGAUCUCU |
| 3089 | 881 | UGUCAUCAGAAAUGCUAUCUU |
| 3090 | 882 | AUCGUAUGCUCAAAGUCUGAA |
| 3091 | 883 | UUCUUCUUCUUCCUCUUCAUC |
| 3092 | 884 | UCUCUCUCAUUAGAGCAGUGU |
| 3093 | 885 | CACACAAGCACACACAUUGAA |
| 3094 | 886 | AUGGGAAGUGGUUUGGAGCUG |
| 3095 | 887 | UAUAGAUAAUAGUCUCCUAAG |
| 3096 | 888 | GAAUAAACUGUUAACAAUCUG |
| 3097 | 889 | UGCAUGUUGGGUUAUAUUCAU |
| 3098 | 890 | UCUAAGAUCUCCUCAUCUGUC |
| 3099 | 891 | UGGAAGUGACCACUUUAUGGU |
| 3100 | 892 | UCUCUAGGUAUAGGGUCUGCU |
| 3101 | 893 | UCUGCAACUUGUAAGUGUUUA |
| 3102 | 894 | UAUUGUAAAGCAAUAUUAUAA |
| 3103 | 895 | AUAUGCUGAACUGAAAGCAUA |
| 3104 | 896 | AAAUCUGAAUAACAUAAAGAA |
| 3105 | 897 | UUCAUCACCCACCAAGUAGCU |
| 3106 | 898 | AGUAGCUACAGGAUUCUGUGA |
| 3107 | 899 | ACAGUUAUACAGACAACAGGA |
| 3108 | 900 | AGAGGUUAAGUGACUUGCCUA |
| 3109 | 901 | UAGACAUUGUUUAAUAUUAAA |
| 3110 | 902 | UGAACACACAUAUUCCUCUCC |
| 3111 | 903 | UUCACUUCAAAUCCCAGGCCC |
| 3112 | 904 | UAUUCCAUGACUACCCAUAGU |
| 3113 | 905 | UGGGAGAUACUUGCACUACUG |
| 3114 | 906 | AACAAGGAUUUCAGUAUUCUA |
| 3115 | 907 | ACAGGUGUGCACAUGGAGGUG |
| 3116 | 908 | UCCAAUCUAAAGCAACCACAA |
| 3117 | 909 | AAUUCCACCACCCUAACACAA |
| 3118 | 910 | UCUUGGGUUGCUGUUGAAGGU |
| 3119 | 911 | AAAGUCUGAAGGAAGAGAGAU |
| 3120 | 912 | UAUUUACAAUGACACACACAC |
| 3121 | 913 | GUAUUCUACAUUUAUCUGGUU |
| 3122 | 914 | UGUUACUAUUCAUCCUCAGUG |
| 3123 | 915 | AAUACCUUUAAUCCAAAGUUA |
| 3124 | 916 | UAAAGAAAGUGCUUUCAUUUU |
| 3125 | 917 | AGAUAUCAACUUUCGGACCAU |
| 3126 | 918 | AACAAAUUAAUUUGUCAACAU |
| 3127 | 919 | UGGUUUGGAGCUGUGGUUGAG |
| 3128 | 920 | ACACAUUGAACUUGAAUUUUG |
| 3129 | 921 | UCAAAGAUUUGGAUAGACUCA |
| 3130 | 922 | UGGAAUCUAGAAUUUGAGAA |
| 3131 | 923 | AGCACACAUUGAACUUGAA |
| 3132 | 924 | UUGCAGCGAUAAUCAGAGGAG |
| 3133 | 925 | AUAAUUUGUAUCAUAAGUAAA |

TABLE 6-continued

Results for PAK3.
Score threshold: 70. Design: siRNA 21 nt.

| SEQ ID NO | siRNA_id | siRNA guide strand/ AS Sequence |
|---|---|---|
| 3134 | 926 | AGAGGGACUACUCUCUAACUU |
| 3135 | 927 | CUAGCAAAUAUCUCUGCCCUG |
| 3136 | 928 | AAUUUCACUACACAUGGUUUA |
| 3137 | 929 | UUCUAGCAAGUGUGACAGUGU |
| 3138 | 930 | UUUACUUAAUGUCCAACAAGG |
| 3139 | 931 | AAUCAGAGGAGUCAGGCUGGA |
| 3140 | 932 | AAGCACACACAUUGAACUUGA |
| 3141 | 933 | UUGGGAUAUGAUUGUAAGUUA |
| 3142 | 934 | UCACUUCAACAUUGCUGCCCU |
| 3143 | 935 | GAACAUCUAGAACAGCUUGUG |
| 3144 | 936 | UAGUGAAACUAAGCAGCAUAU |
| 3145 | 937 | AAGUACAGUUAUAUUCUAGCA |
| 3146 | 938 | UGAAUUUCCCGGCACUAUGAG |
| 3147 | 939 | AAGUUUGGAGUAAUCGUGCCC |
| 3148 | 940 | UAUGAGUAUAAUCCCAGUAGA |
| 3149 | 941 | AACAUGGACACACAAAUAUUU |
| 3150 | 942 | UUCUUCCUAGGCUAGUAUUUA |
| 3151 | 943 | AAGCCCUUCCUGAACACACAU |
| 3152 | 944 | ACAUUUAUGAAUAUGCUUUUG |
| 3153 | 945 | ACUGUCAGUUUACAAAUGCUG |
| 3154 | 946 | UAUUAUGGGAUAGCAUUUGCC |
| 3155 | 947 | AUUUAUUUCCUUCCCAGUCCA |
| 3156 | 948 | ACACACACACGAGAUCAGCAA |
| 3157 | 949 | UGUCCAACAAGGAUUUCAGUA |
| 3158 | 950 | UGUAUUGAGAAUGACCAAUAA |
| 3159 | 951 | UUUCUGGUUGUUGACUGUUUC |
| 3160 | 952 | ACACAGUCACUAAUGUACUGA |
| 3161 | 953 | UUCCCGCAUUUGCAGAUUCAG |
| 3162 | 954 | UUCUUACAGAGUUGAAUGUUU |
| 3163 | 955 | AAUGCUACAAGUUGUAUAGAA |
| 3164 | 956 | AAUCCUUCAGCAUCACUGUGG |
| 3165 | 957 | AGUUUCACUCUUGUUGCCGAG |
| 3166 | 958 | UCAUCUUCUUCUUCAGACACA |
| 3167 | 959 | UUGCAAUACUUUAGGUCCAAG |
| 3168 | 960 | UAUGUUGGUCAGGCUGGUCUC |
| 3169 | 961 | UUUACCCUCUUUCCAGCAGUG |
| 3170 | 962 | UCUACACAGACACUCCGCAGA |
| 3171 | 963 | ACAGCUUCUUUCUAAUACUUA |
| 3172 | 964 | CAACUUUCGGACCAUAAGCUU |
| 3173 | 965 | AAAGCCUAUGGAAUAAUUGUA |
| 3174 | 966 | AUGAUUUCAAAGUCAGCUUUU |
| 3175 | 967 | UUCCUUCCCAGUCCACAUGCA |
| 3176 | 968 | AUGUUGGUCAGGCUGGUCUCG |
| 3177 | 969 | UAUCUGUCCUUCAUCCAUACA |
| 3178 | 970 | UUGCAACUCUAUUAGGGCAUG |
| 3179 | 971 | AUGCUAACUAAUGAAUAGGGC |
| 3180 | 972 | UGUUCUUAAUUGCUUCCUUUG |
| 3181 | 973 | AUCUGAAGGGUCACUGCUCCA |
| 3182 | 974 | UACUAAAUCUGUUGAACAUGU |
| 3183 | 975 | ACUUAUAGAUAAUAGUCUCCU |
| 3184 | 976 | AUCUUCUUCUUCAGACACAGG |
| 3185 | 977 | AACUACUGCAAACAACCUAUA |
| 3186 | 978 | UCUCUAUGGAUCACCUGGUUU |
| 3187 | 979 | AUUGUACCAAAUGUGAAUCCU |
| 3188 | 980 | UUCUCAAUGCUAAUAGCAUGU |
| 3189 | 981 | AUUUCUUACAGAGUUGAAUGU |
| 3190 | 982 | UAUAUCACCUUUCUCUAGAUC |
| 3191 | 983 | AAUUAAUUUGUCAACAUUUCU |
| 3192 | 984 | UGUUUACUUAAUGUCCAACAA |
| 3193 | 985 | UCAGUUACAACUAAUUUCACA |
| 3194 | 986 | UCUAAUACUUAUUAGAAAUAU |
| 3195 | 987 | ACGUACACUAUAUAGUUUGCU |
| 3196 | 988 | UGCAACAGAUGUUAUCAAGGG |
| 3197 | 989 | UUCUGGAGCUCUGGAGUUCCA |
| 3198 | 990 | UUACAUGAAUACAAAUUUAUA |
| 3199 | 991 | UUAUGGUCACUUCAACAUUGC |
| 3200 | 992 | AAGUCAUAUAAGGAAUUCUGU |
| 3201 | 993 | UAACUGCAAGUAGCUUAGAUA |
| 3202 | 994 | ACAGUUAUAUUCUAGCAAGUG |
| 3203 | 995 | AAGUGGUUUGGAGCUGUGGUU |
| 3204 | 996 | UCUGAGGUGACUACCUCAUUA |
| 3205 | 997 | AACACUCACAAUGCUUCUUAG |
| 3206 | 998 | UAUAACAAUAUCAAUAAAAU |
| 3207 | 999 | ACACACAUUGAACUUGAAUUU |

TABLE 6-continued

Results for PAK3.
Score threshold: 70. Design: siRNA 21 nt.

| SEQ ID NO | siRNA_id | siRNA guide strand/ AS Sequence |
|---|---|---|
| 3208 | 1000 | AAUAGCAUGUAAUUACUUUUU |
| 3209 | 1001 | UUAUUAUCAAAUCUUGGUACA |
| 3210 | 1002 | AAAGAAUAAAUACUUGAGUUA |
| 3211 | 1003 | CUGAAUUUCAGUCCUCUUGUU |
| 3212 | 1004 | AUGAACUUCAUUUGCUUGAGU |
| 3213 | 1005 | ACAUCCAUCUCAAGACAGCGA |
| 3214 | 1006 | UAUUUGGUACUGCUGGUGAAG |
| 3215 | 1007 | AGGAUUUCAUUGAAUUUCCCG |
| 3216 | 1008 | UUAGAUAAAGACCAAGAGAUU |
| 3217 | 1009 | AAGAGACCAGAUAUCAACUUU |
| 3218 | 1010 | AUCAUCUUACAUAGUUCUUUU |
| 3219 | 1011 | AUAACACAAAUUGUUAGUUUU |
| 3220 | 1012 | CACUUCAACAUUGCUGCCCUG |
| 3221 | 1013 | AGACAGUCCUACAUAUUUGUU |
| 3222 | 1014 | UAGUGCUGUAUAAACAGUACC |
| 3223 | 1015 | UAUACUGCAAAUUAAGAAGCC |
| 3224 | 1016 | AUUUAGGUAUCAUUAUCUUUG |
| 3225 | 1017 | AAACAGAAAUAGGUGAUACAU |
| 3226 | 1018 | UCUUCUUCCUCUUCAUCUUCU |
| 3227 | 1019 | UCAUUUCUCUCUGCAACUUGU |
| 3228 | 1020 | AAUAAUUGUAACUAGCAAAUA |
| 3229 | 1021 | AACUUCAUUUGCUUGAGUUUU |
| 3230 | 1022 | UGUUCACACAGUACUUGCUCU |
| 3231 | 1023 | UAUCCAGACCGUCAGACAUUU |
| 3232 | 1024 | AAAGCUCAUGUAUUUCUGGUU |
| 3233 | 1025 | UCACGGAAUACAGCUGACAGU |
| 3234 | 1026 | UGGAACCAUACCAUCAGCAGG |
| 3235 | 1027 | UUGGAAUCAUAGAAUUGAGA |
| 3236 | 1028 | UAAACACGUACACUAUAUAGU |
| 3237 | 1029 | CACAACACUAUGAAGAGGGAG |
| 3238 | 1030 | CACACUAGCAACAUCAAAGAU |
| 3239 | 1031 | UCCAUCUUUCCUGCAGCAGAG |
| 3240 | 1032 | AUAUAAGGAAUUCUGUCGGAC |
| 3241 | 1033 | CAACAUUAACGUUCUUUCCUU |
| 3242 | 1034 | UGGUGUGACCUCUUUAUUUGG |
| 3243 | 1035 | AUAAAGAAUAAAUACUUGAGU |
| 3244 | 1036 | UAUACAUAACUCUCCAAUACA |
| 3245 | 1037 | UGUUGGGUUAUAUUCAUUUGG |
| 3246 | 1038 | UCCUAUGAGGAUUUCCUAGGU |
| 3247 | 1039 | UUCUAAAGGAGACUCCGAUGG |
| 3248 | 1040 | UCCUGAUGUAAAGCUCAUGUA |
| 3249 | 1041 | AUUUCAUUGAAUUUCCCGGCA |
| 3250 | 1042 | AAUCUCUACUGUGCUUCUCAC |
| 3251 | 1043 | AUCUGUCCUUCAUCCAUACAG |
| 3252 | 1044 | AUCUCCUGAUGUAAAGCUCAU |
| 3253 | 1045 | UCCAGCAGUGUACUCAUCAUA |
| 3254 | 1046 | UGCAUGGGCUCUGCUAUCUUG |
| 3255 | 1047 | AAUGCUAUCUUUGGUUCCCAA |
| 3256 | 1048 | AUGCUGAAUUUCAGUCCUCUU |
| 3257 | 1049 | UCUCCUGAUGUAAAGCUCAUG |
| 3258 | 1050 | UACCCAUAGUUCAUCACCCAC |
| 3259 | 1051 | UACAUAUUUGUUUAAUGAUUU |
| 3260 | 1052 | AUGGAAUGUGCUUCACCGGGG |
| 3261 | 1053 | UCUGCCUACAGUGAUCUGAAG |
| 3262 | 1054 | CAAGUCAUAACUUCUAUUGAA |
| 3263 | 1055 | CUUUCUUAUUCUUCUCUUCAG |
| 3264 | 1056 | ACACACAAGCACACACAUUGA |
| 3265 | 1057 | UGCAAAUUAAGAAGCCUUCUA |
| 3266 | 1058 | UCAUUAUCUUUGUUUACUUAA |
| 3267 | 1059 | AAUCUGAAUAACAUAAAGAAU |
| 3268 | 1060 | UAAAUGUGGUUUCUCCUAUGA |
| 3269 | 1061 | UCCUCUUUCAGGUAUUAAGGA |
| 3270 | 1062 | AACACUAUGAAGAGGGAGUGU |
| 3271 | 1063 | UAAUAUUACCGUUUCAUUUUC |
| 3272 | 1064 | UCAUCAGAAAUGCUAUCUUUG |
| 3273 | 1065 | UUAUUCCAAGUUCCCAUUUA |
| 3274 | 1066 | UAUCCUUCUAGUCCUCCAAAA |
| 3275 | 1067 | UUCCCAACAAAUUAAUUUGUC |
| 3276 | 1068 | AUCCUCGCCUAUCCACAUCCA |
| 3277 | 1069 | UUAUAUCUCUAUGGAUCACCU |
| 3278 | 1070 | CUUUGUUUACUUAAUGUCCAA |
| 3279 | 1071 | AUUGAAAGAUGUGCCCUCGUU |
| 3280 | 1072 | UAUUCCUAACUCAGGACAUUU |
| 3281 | 1073 | CUUCUCUAGGUAUAGGGUCUG |

TABLE 6-continued

Results for PAK3.
Score threshold: 70. Design: siRNA 21 nt.

| SEQ ID NO | siRNA_id | siRNA guide strand/ AS Sequence |
|---|---|---|
| 3282 | 1074 | UCACCUUUCUCUAGAUCUUUA |
| 3283 | 1075 | AACUUAUAGAUAAUAGUCUCC |
| 3284 | 1076 | UGGACACACAAAUAUUUACAA |
| 3285 | 1077 | UUCUUCAGACACAGGAGGGGC |
| 3286 | 1078 | UCUCGAACUCCUGACCUCAGG |
| 3287 | 1079 | UUGCAAGUUCAACCCAAUUAA |
| 3288 | 1080 | UGUGAAGAUCUUAUCAUCAAU |
| 3289 | 1081 | UCAUUAUUAAAGUUCUCACCU |
| 3290 | 1082 | AUUAUGGGAUAGCAUUUGCCU |
| 3291 | 1083 | AAAUACACGUUCAGAAUUGUG |
| 3292 | 1084 | AGCUUGUGGGUUCUUCUUCUG |
| 3293 | 1085 | UAUUUACACGAUCUUUGAGCU |
| 3294 | 1086 | UGAAUUUCAGUCCUCUUGUUC |
| 3295 | 1087 | UCUCUGUGACCACAUCAGUCA |
| 3296 | 1088 | UAAAUGAAUUGGAAGGCUGCC |
| 3297 | 1089 | UCAGAUACAAUGCCCUGAGUG |
| 3298 | 1090 | CAAGCACACACAUUGAACUUG |
| 3299 | 1091 | UGCUGUUGAAGGUUCAUCUGC |
| 3300 | 1092 | UUCCCACCAUAGUGCUUCGUU |
| 3301 | 1093 | UGUUAUGUUGGAAGUUUGGAG |
| 3302 | 1094 | AUUAUCCAGACCGUCAGACAU |
| 3303 | 1095 | UUGAAUGUUUACUAUAUCACC |
| 3304 | 1096 | AUGAAUAGGGCUUCCUAACCA |
| 3305 | 1097 | AGCAACAUCAAAGAUUUGGAU |
| 3306 | 1098 | UGAAAUUAGUGGGACUUGCCC |
| 3307 | 1099 | UAACCAGGUAUGGGCUCUCU |
| 3308 | 1100 | UCAAUAAUGAAUAUGGUAUUU |
| 3309 | 1101 | AAGAAGUUUCUAUUCAUUUGA |
| 3310 | 1102 | UGGAGACGAAGUUUCACUCUU |
| 3311 | 1103 | CAACAUAAGAGACUCAGGCUU |
| 3312 | 1104 | UAAAUAAUUUGUAUCAUAAGU |
| 3313 | 1105 | UAAUAUCCUGUUGGACAAGAA |
| 3314 | 1106 | GAAUCCUUCAGCAUCACUGUG |
| 3315 | 1107 | UGCAGAUUCAGUUAGACAUUG |
| 3316 | 1108 | UAUUAUAGAAUCUCUCAGAAC |
| 3317 | 1109 | AUUGGGACCAUCCACUAACUC |
| 3318 | 1110 | AAAUAUUCCAUUAUUUCCAAG |
| 3319 | 1111 | AGAAAUAGGUGAUACAUAGGA |
| 3320 | 1112 | UCUAUUGCUUCAACCACAAUU |
| 3321 | 1113 | UUUAUUUAUUGUAAAGCAAUA |
| 3322 | 1114 | UUUAAUCCAAAGUUACAGAAG |
| 3323 | 1115 | CAAGUUACUCGAUUGUACCAA |
| 3324 | 1116 | AUAAGCACAAGAGAGGAUUAA |
| 3325 | 1117 | UCAGCCUCCCAAGUAGCUGGG |
| 3326 | 1118 | AUUUCUCAAUGCUAAUAGCAU |
| 3327 | 1119 | AAGACCCUAAGGAUCAUCUAG |
| 3328 | 1120 | GAGAAGAAUAUUGUCACUCUU |
| 3329 | 1121 | UCUAUAACACAAAUUGUUAGU |
| 3330 | 1122 | UCACUGCUCCAAGGUCUCCAA |
| 3331 | 1123 | AUUUGGUCACUUAAAGGAGUG |
| 3332 | 1124 | UCCUUCAUCCAUACAGGUCUC |
| 3333 | 1125 | CUACAUCGACUCAUUCUCUA |
| 3334 | 1126 | UCUUCCAUCUUUCCUGCAGCA |
| 3335 | 1127 | ACUGCAACAUAAGAGACUCAG |
| 3336 | 1128 | AAGCAAUGGAUUCAACCACAG |
| 3337 | 1129 | CUCUGUGACCACAUCAGUCAG |
| 3338 | 1130 | AUCCCGGUUGUUACUAUUCAU |
| 3339 | 1131 | AGAAGAUUCAGGAAGUGCCAA |
| 3340 | 1132 | AAGCCCAGCACUACUUCACAG |
| 3341 | 1133 | AAAUGUGGUUUCUCCUAUGAG |
| 3342 | 1134 | AUCUAAAUAAUUAACAAUAUU |
| 3343 | 1135 | UAUCUCUGCCCUGCAUGCUCU |
| 3344 | 1136 | AUUAAACACAUUCCCAAUGCA |
| 3345 | 1137 | UAGUAUGCUUCAAAUUAAUAU |
| 3346 | 1138 | UCCUAGAAAGCGUGUGCCAU |
| 3347 | 1139 | AGAAGGAUGGAACCAUACCAU |
| 3348 | 1140 | UUAGGGCAUGGACUUCCACAU |
| 3349 | 1141 | AAACUCUAGAAAGCCCAGCAC |
| 3350 | 1142 | AACAUGGUGACUGAUUUGAGG |
| 3351 | 1143 | AAAUAAUUUGUAUCAUAAGUA |
| 3352 | 1144 | CUUAACUGAAUAUUAACUGCA |
| 3353 | 1145 | AGAAAUAAACCCAUUGAGCAA |
| 3354 | 1146 | UAGAAAGCCCAGCACUACUUC |
| 3355 | 1147 | UCCUGUUGCAAUGUCUAGUGC |

TABLE 6-continued

Results for PAK3.
Score threshold: 70. Design: siRNA 21 nt.

| SEQ ID NO | siRNA_id | siRNA guide strand/ AS Sequence |
|---|---|---|
| 3356 | 1148 | AAGAAGCCUUCUAUAACACAA |
| 3357 | 1149 | CACAUGUUCACACAGUACUUG |
| 3358 | 1150 | CAUUAUUAAAGUUCUCACCUA |
| 3359 | 1151 | UUGUUACUAUUCAUCCUCAGU |
| 3360 | 1152 | UGGGAAGAUAGAGCGAAGCCU |
| 3361 | 1153 | AGAAUACUCGUACACACAGGU |
| 3362 | 1154 | UCUUCCUCUUCAUCUUCUUCU |
| 3363 | 1155 | UCAUGCACAAUCCAUAUUUCA |
| 3364 | 1156 | AACUAGCAAAUAUCUCUGCCC |
| 3365 | 1157 | UUUCUCUUCAUUAUCCAGACC |
| 3366 | 1158 | AAUGCUAAUAGCAUGUAAUUA |
| 3367 | 1159 | UCAGAGCUCAGAGACUGGGAG |
| 3368 | 1160 | UUUGGAGUUCUAAUAGUGACA |
| 3369 | 1161 | UCACUGACCUCCCAUUUCUUA |
| 3370 | 1162 | UAAUGUCCAACAAGGAUUUCA |
| 3371 | 1163 | UCCUUCUUCUUUAUUGGUUUUA |
| 3372 | 1164 | UGCAAGUCAUAACUUCUAUUG |
| 3373 | 1165 | UAAGAUGUGGAUAUAUGGAUG |
| 3374 | 1166 | ACGUGGAUCCUUCUCAACUUG |
| 3375 | 1167 | AAUACUUGAGUUAAAUCUUCU |
| 3376 | 1168 | AGUGUACUCAUCAUACAACUG |
| 3377 | 1169 | UCUCAGGAUUCUGGAGCUCUG |
| 3378 | 1170 | UCCUACCUGAAUGAUAUACAG |
| 3379 | 1171 | AUAGGGCUUCCUAACCAGGUA |
| 3380 | 1172 | AUAUAUGGUGAAAUAGUAGUC |
| 3381 | 1173 | AGUGAUAUUAUAGAAUCUCUC |
| 3382 | 1174 | AUGUAUCUAUUCCUCCUGGU |
| 3383 | 1175 | AAAGUCAGUCAAUUUAACAGA |
| 3384 | 1176 | UUUGGGCUGCGAUUCAGGCUU |
| 3385 | 1177 | UCUUUGUCCAUAUGCAUUUCU |
| 3386 | 1178 | UUUGAAUGCAAGAGGGACUAC |
| 3387 | 1179 | AUUUAUUGUAAAGCAAUAUUA |
| 3388 | 1180 | UUUCUGCUGUUUAUUUAUUGU |
| 3389 | 1181 | AAUAUCUCUGCCCUGCAUGCU |
| 3390 | 1182 | UUUGUUUACUUAAUGUCCAAC |
| 3391 | 1183 | AUAUGGUAUUUGCGGGUCCAU |
| 3392 | 1184 | AUUAUUAUCAAAUCUUGGUAC |
| 3393 | 1185 | UAAAUGCUACAAGUUGUAUAG |
| 3394 | 1186 | AUAGUUUGCUGAAACUCUAAA |
| 3395 | 1187 | UGCUAACUAAUGAAUAGGGCU |
| 3396 | 1188 | UUCCAGAAAGGCAAUAUCUGC |
| 3397 | 1189 | AGAACCUGAACUCACCUAGCA |
| 3398 | 1190 | UGAUGAUUAAUGUAUCUAUUU |
| 3399 | 1191 | UCCGAAACAGAAAUAGGUGAU |
| 3400 | 1192 | UUGUCAUCAGAAAUGCUAUCU |
| 3401 | 1193 | UUUGAAAGGUAAAGAACCCCC |
| 3402 | 1194 | CUUAGAGAAACAACUUUCUGU |
| 3403 | 1195 | AUAUCAUUUAUAGACAAAUAU |
| 3404 | 1196 | AGGAUUUCACCGUUUGAGCUU |
| 3405 | 1197 | UAGUGGGACUUGCCCUAUUGG |
| 3406 | 1198 | AUAUUUGUUUAAUGAUUUCAA |
| 3407 | 1199 | UCACAUAGCAAUUUAGUAAUA |
| 3408 | 1200 | GAAUACUCGUACACACAGGUG |
| 3409 | 1201 | UUCCACAUGUUCACACAGUAC |
| 3410 | 1202 | AACCUGAACUCACCUAGCAGG |
| 3411 | 1203 | UCUUACAGAGUUGAAUGUUUA |
| 3412 | 1204 | UACUUCACAGGAAAGGAGAAG |
| 3413 | 1205 | CAACUUGUAAGUGUUUAGGUU |
| 3414 | 1206 | GCUAACAACAUUAACGUUCUU |
| 3415 | 1207 | AUUCAGUUAGACAUUGUUUAA |
| 3416 | 1208 | UACAAAGUGGUAGUAAAGAAG |
| 3417 | 1209 | UACAUAAGUUCUGUUUAGAUU |
| 3418 | 1210 | AAAUAUACAUAACUCUCCAAU |
| 3419 | 1211 | UGUCCUUCAUCCAUACAGGUC |
| 3420 | 1212 | AUGCUCUGGUCUUGGUGCGAU |
| 3421 | 1213 | AGUAUUCUACAUUUAUCUGGU |
| 3422 | 1214 | AUAAACAGUACCUGAUGCCCC |
| 3423 | 1215 | UCAUCUCCUGAACAUAAACAC |
| 3424 | 1216 | UAGUAUUUAUCCCACUACAUC |
| 3425 | 1217 | AUCCCACUACAUCUGACUCAU |
| 3426 | 1218 | CAUAGAAUUUGAGAACAUCUA |
| 3427 | 1219 | UACACACAGGUGUGCACAUGG |
| 3428 | 1220 | AACGAAGUCAUUACCCAACAU |
| 3429 | 1221 | UUGAGUGCAGGAAAUCCAAAG |

TABLE 6-continued

Results for PAK3.
Score threshold: 70. Design: siRNA 21 nt.

| SEQ ID NO | siRNA_id | siRNA guide strand/ AS Sequence |
|---|---|---|
| 3430 | 1222 | UAGGCAGGGCAUUGGGACCAU |
| 3431 | 1223 | AUGUGAAUCCUUCAGCAUCAC |
| 3432 | 1224 | ACACACAGGUGUGCACAUGGA |
| 3433 | 1225 | UCAUAGGAGAAAUAUUCCAUU |
| 3434 | 1226 | UCUGCUGUUUAUUUAUUGUAA |
| 3435 | 1227 | CUUCAAAUUAAUAUUACCGUU |
| 3436 | 1228 | UCUCGGGCGCUCUUUCUCCU |
| 3437 | 1229 | UCCUAGGCUAGUAUUUAUCCC |
| 3438 | 1230 | UUUCUCUGCCUACAGUGAUCU |
| 3439 | 1231 | CAACAUUGAAAGAUGUGCCCU |
| 3440 | 1232 | UUCUUAGCUUCUCUAAGAUCU |
| 3441 | 1233 | ACAGUCUCUCAGGAUUCUGGA |
| 3442 | 1234 | UGGUUUACUCAAUUAUCUUUU |
| 3443 | 1235 | AGUUCUAAUAGUGACAUCUCC |
| 3444 | 1236 | ACCACACACAAGCACACACAU |
| 3445 | 1237 | UCUCUAUGUUGGUCAGGCUGG |
| 3446 | 1238 | UCAAGUCUGAAGGAAGAGAG |
| 3447 | 1239 | AGACCAAGAGAUUCAACCGGG |
| 3448 | 1240 | UUCACCUUCCACCAUUUCAAU |
| 3449 | 1241 | CAAAGUAUAACAUAGUAUGCU |
| 3450 | 1242 | UAGCUACAGGAUUCUGUGAAG |
| 3451 | 1243 | AAUAUCUGCAACAGAUGUUAU |
| 3452 | 1244 | ACAAUGACACACACGAGAU |
| 3453 | 1245 | AAGUUCACUCUUGUUGCCGA |
| 3454 | 1246 | AACAUUGAAAGAUGUGCCCUC |
| 3455 | 1247 | UCUGCAACAGAUGUUAUCAAG |
| 3456 | 1248 | GUGGUAGUAAAGAAGUACCUG |
| 3457 | 1249 | AUGCUUCUUAGCUUCUCUAAG |
| 3458 | 1250 | UGCUGAAGAAUCCCGGUUGUU |
| 3459 | 1251 | ACUACAUCUGACUCAUUCUCU |
| 3460 | 1252 | UUCGCUUCACGGUGGAAGUGA |
| 3461 | 1253 | AAGCUCAUGUAUUUCUGGUUG |
| 3462 | 1254 | UCUCCUCAUCUGUCAUCUUGG |
| 3463 | 1255 | AUUACAUAAUCUGAGGGAGUA |
| 3464 | 1256 | AUUCUCUACUAUCGCUGUUGA |
| 3465 | 1257 | AUCACAUUGGGUAAGGAGUUU |
| 3466 | 1258 | UUUCUUUGGUGAGUUAGAAGG |
| 3467 | 1259 | CAAUUUAGUAAUAAAGCUCAU |
| 3468 | 1260 | AUUGCUGCCCUGUUUGGGCUG |
| 3469 | 1261 | AUCUUUGUUUAAAUGUGGUUU |
| 3470 | 1262 | ACAGGAAGCAAUUUCGUGUUU |
| 3471 | 1263 | UUCAAGCGAUUCUCCCACCUC |
| 3472 | 1264 | AUACAGGUCUCUGUGACCACA |
| 3473 | 1265 | AAACAACUGUAAAUGAAUUGG |
| 3474 | 1266 | UAACAACCUGGUUUACUCAAU |
| 3475 | 1267 | AUAGUUGUAAUCCCUGUUUAU |
| 3476 | 1268 | GAACCUGAACUCACCUAGCAG |
| 3477 | 1269 | AUGAUGAUUAAUGUAUCUAUU |
| 3478 | 1270 | AAGAGAGGAUUAAUUUAGGUA |
| 3479 | 1271 | GUUUACAGAUAACACAUUCUG |
| 3480 | 1272 | UAUCUAUUCCUCCUGGUAUG |
| 3481 | 1273 | AUAGAUAAUAGUCUCCUAAGA |
| 3482 | 1274 | UAUCCCACUGUGGACAUUUUC |
| 3483 | 1275 | UUGAAUUUCCCGGCACUAUGA |
| 3484 | 1276 | AAUUUAGUAAUAAAGCUCAUA |
| 3485 | 1277 | UUGCAUCCCAGGAUUUCAUUG |
| 3486 | 1278 | UCUUUCCAGCAGUGUACUCAU |
| 3487 | 1279 | UACCAUCAGCAGGUCUACAAA |
| 3488 | 1280 | UCAUCUUCUUCUUCUUCUUCC |
| 3489 | 1281 | AUCCAUACAGGUCUCUGUGAC |
| 3490 | 1282 | UAGCAAAUAUCUCUGCCCUGC |
| 3491 | 1283 | UCAGGUGAUCCGCCUGCCUUG |
| 3492 | 1284 | AGAGACUCAGGCUUAAACGUG |
| 3493 | 1285 | UCUGUGAAGAUCUUAUCAUCA |
| 3494 | 1286 | UUAUUAGAAAUAUACAUAACU |
| 3495 | 1287 | AGCUUCUCUAAGAUCUCCUCA |
| 3496 | 1288 | AACCACAGAACGAGUAUAGAU |
| 3497 | 1289 | UCAGGAUUCUGGAGCUCUGGA |
| 3498 | 1290 | UACAAAUAAUUCAUAAUCU |
| 3499 | 1291 | UCAUUAAUAAUUAAUUCCUUC |
| 3500 | 1292 | UAAUUGUAACUAGCAAAUAUC |
| 3501 | 1293 | UUAAGGCCUCUCUCUCUCAUU |
| 3502 | 1294 | CAUUUCUCUCUGCAACUUGUA |
| 3503 | 1295 | UCUAAAUAAUUAACAAUAUUA |

TABLE 6-continued

Results for PAK3.
Score threshold: 70. Design: siRNA 21 nt.

| SEQ ID NO | siRNA_id | siRNA guide strand/ AS Sequence |
|---|---|---|
| 3504 | 1296 | ACAACCUAUAAAUAGGCAGAA |
| 3505 | 1297 | UUGGGCUGCGAUUCAGGCUUA |
| 3506 | 1298 | AAGAGAAUAAACUGUUAACAA |
| 3507 | 1299 | AUUUGUAUCAUAAGUAAAUGA |
| 3508 | 1300 | UGCAACAUAAGAGACUCAGGC |
| 3509 | 1301 | UUAGUGGGACUUGCCCUAUUG |
| 3510 | 1302 | AUGGAACCAUACCAUCAGCAG |
| 3511 | 1303 | CCAGUAGACAUCACUACCCUG |
| 3512 | 1304 | UCCCAUUUAUUCCUUCCCAG |
| 3513 | 1305 | GAACUAAGCAUGAACACACCA |
| 3514 | 1306 | CUUUAUUGGUACUGCUGGUG |
| 3515 | 1307 | AAUAAAUUACAUAAUCUGAGG |
| 3516 | 1308 | UUCCAUUAUUUCCAAGUUCCC |
| 3517 | 1309 | AUCAGCAAGAACGAAGUCAUU |
| 3518 | 1310 | CUAACAACAUUAACGUUCUUU |
| 3519 | 1311 | AACAGAACUAUAACUGAAUGC |
| 3520 | 1312 | ACAAUUAAUUUGUCAACAUU |
| 3521 | 1313 | UCGUACACACAGGUGUGCACA |
| 3522 | 1314 | GUUCACACAGUACUUGCUCUG |
| 3523 | 1315 | ACACGUACACUAUAUAGUUUG |
| 3524 | 1316 | AAAGACCCUAAGGAUCAUCUA |
| 3525 | 1317 | UUACAGGCCCAGAUUCGUUUU |
| 3526 | 1318 | CUCAAGUACAGUUAUAUUCUA |
| 3527 | 1319 | UGGAAAGACCCUAAGGAUCAU |
| 3528 | 1320 | AAAGGCAAUAUCUGCAACAGA |
| 3529 | 1321 | CAUGAACACACCAUAUUCCGA |
| 3530 | 1322 | ACUUAAGGAGUGUGGAUCAG |
| 3531 | 1323 | UUGCAGGCACUCUCUGCAGAC |
| 3532 | 1324 | UGUUUGGAGUUCUAAUAGUGA |
| 3533 | 1325 | UGACAUUUCUUGGGAUAUGAU |
| 3534 | 1326 | UUCACUCUUAGCAGUCUCAGC |
| 3535 | 1327 | UACAAAUGCUGAAUUUCAGUC |
| 3536 | 1328 | AAAUAAUCUCUACUGUGCUUC |
| 3537 | 1329 | AAGAAUAAAUACUUGAGUUAA |
| 3538 | 1330 | UCACAGUUUCAGUUUCAGUGU |
| 3539 | 1331 | ACUACUGCAAACAACCUAUAA |
| 3540 | 1332 | AUUGGGAUGUAGCCUUCACUG |
| 3541 | 1333 | AAGUAGCUUAGAUAAAGACCA |
| 3542 | 1334 | AAUGAUGAUUAAUGUAUCUAU |
| 3543 | 1335 | ACAGGAUUCUGUGAAGAUCUU |
| 3544 | 1336 | UAGGUCCAAGUUUCAAACUGC |
| 3545 | 1337 | AGCUUCUAAAGGAGACUCCGA |
| 3546 | 1338 | AAUCACUGUGGGAGUUGUCAU |
| 3547 | 1339 | UAAACUCUAGAAAGCCCAGCA |
| 3548 | 1340 | UCAGGCUGGUCUCGAACUCCU |
| 3549 | 1341 | AUGUCCAACAAGGAUUUCAGU |
| 3550 | 1342 | UUUGGAGCUGUGGUUGAGUGC |
| 3551 | 1343 | CAGGCUGGUCUCGAACUCCUG |
| 3552 | 1344 | UGAAUCGUAUGCUCAAAGUCU |
| 3553 | 1345 | UCACCGUUUGAGCUUUAUUUA |
| 3554 | 1346 | AAUCGUGCCCAUUGCUCUGGA |
| 3555 | 1347 | GAAUGUUUACUAUAUCACCUU |
| 3556 | 1348 | UGUAUCAUAAGUAAAUGAUGA |
| 3557 | 1349 | UAACAAUAUUAGGGUUCUUAU |
| 3558 | 1350 | CUGAAUUUGCAAGGCAACCUA |
| 3559 | 1351 | UUGUAAAGCAAUAUUAUAACA |
| 3560 | 1352 | UACCCUCUUUCCAGCAGUGUA |
| 3561 | 1353 | AACAAUAUUAGGGUUCUUAUU |
| 3562 | 1354 | AAUUAAUUCCUUCUUGGGUUG |
| 3563 | 1355 | UCAGAGACUGGGAGAUACUUG |
| 3564 | 1356 | CAAGUUGUAUAGAAUACUCGU |
| 3565 | 1357 | UUCUCUCUGCAACUUGUAAGU |
| 3566 | 1358 | UCACAAUGCUUCUUAGCUUCU |
| 3567 | 1359 | UGUCCAUAUGCAUUUCUUUUU |
| 3568 | 1360 | AACAUAAGAGACUCAGGCUUA |
| 3569 | 1361 | UUGAAAUUAGUGGGACUUGCC |
| 3570 | 1362 | UCCUUCCCAGUCCACAUGCAA |
| 3571 | 1363 | AAUAUUAAACACAUUCCCAAU |
| 3572 | 1364 | UGUAUAGAAUACUCGUACACA |
| 3573 | 1365 | CUGUUGAAGGUUCAUCUGCUU |
| 3574 | 1366 | UAGGAGAAAUAUUCCAUUAUU |
| 3575 | 1367 | CACACAUUGAACUUGAAUUUU |
| 3576 | 1368 | GUUGUUACUAUUCAUCCUCAG |
| 3577 | 1369 | ACAGAGUUGAAUGUUUACUAU |

TABLE 6-continued

Results for PAK3.
Score threshold: 70. Design: siRNA 21 nt.

| SEQ ID NO | siRNA_id | siRNA guide strand/ AS Sequence |
|---|---|---|
| 3578 | 1370 | UUCACCGUUUGAGCUUUAUUU |
| 3579 | 1371 | CAAUGGAAUGUGCUUCACCGG |
| 3580 | 1372 | UGUUGGUCAGGCUGGUCUCGA |
| 3581 | 1373 | UGUCCUGUUGCAAUGUCUAGU |
| 3582 | 1374 | CUUCUAUUGAAAUUAGUGGGA |
| 3583 | 1375 | UAUAUUCUAGCAAGUGUGACA |
| 3584 | 1376 | UAAAGGAGUGUGGAUCAGAAA |
| 3585 | 1377 | UUGCUGAAACUCUAAAGAAAG |
| 3586 | 1378 | UUUCUAAUACUUAUUAGAAAU |
| 3587 | 1379 | UUUGCUUAACUGAAUAUUAAC |
| 3588 | 1380 | UUCACGGUGGAAGUGACCACU |
| 3589 | 1381 | AGGUCUCUGUGACCACAUCAG |
| 3590 | 1382 | UGACAACGCACUGGAUCCUUG |
| 3591 | 1383 | UCCUCUUCAUCUUCUUCUUCA |
| 3592 | 1384 | AUACAGACAACAGGAAGCAAU |
| 3593 | 1385 | GAUGUUAUGAGUAUAAUCCCA |
| 3594 | 1386 | AUUUAUCCCACUACAUCUGAC |
| 3595 | 1387 | AUAUAUGGAUGGUUAGAUGGA |
| 3596 | 1388 | UAAGUAAAUGAUGAUUAAUGU |
| 3597 | 1389 | AUUAUCUUUGUUUACUUAAUG |
| 3598 | 1390 | CAGAACUAUAACUGAAUGCCA |
| 3599 | 1391 | AAAGCAUAAGAGAGAAGCCAU |
| 3600 | 1392 | AGAAGUUUCUAUUCAUUUGAA |
| 3601 | 1393 | AAUUAUUUACACGAUCUUUGA |
| 3602 | 1394 | UGCUGAGGUCAGAAGGAUGGA |
| 3603 | 1395 | AAAUUAAUAUUACCGUUUCAU |
| 3604 | 1396 | UCAUUGAAUUUCCCGGCACUA |
| 3605 | 1397 | UUAUUUACACGAUCUUUGAGC |
| 3606 | 1398 | UUGGAUGCUGAGGUCAGAAGG |
| 3607 | 1399 | UUUAUGAUUUCAAAGUCAGC |
| 3608 | 1400 | AAGUUCAACCCAAUUAAGUGG |
| 3609 | 1401 | AAAUGAGAUACAAUUCUGAUA |
| 3610 | 1402 | GUAGCCUUCACUGACCUCCCA |
| 3611 | 1403 | AGGAUGGAACCAUACCAUCAG |
| 3612 | 1404 | AUCCUUGCUAACAACAUUAAC |
| 3613 | 1405 | UUCAGGCUUACAAAUAAAUUA |
| 3614 | 1406 | UCUUGUCCUGUUGCAAUGUCU |

TABLE 6-continued

Results for PAK3.
Score threshold: 70. Design: siRNA 21 nt.

| SEQ ID NO | siRNA_id | siRNA guide strand/ AS Sequence |
|---|---|---|
| 3615 | 1407 | ACAGACAACAGGAAGCAAUUU |
| 3616 | 1408 | UUACAGAGUUGAAUGUUUACU |
| 3617 | 1409 | AACAACAUUAACGUUCUUUCC |
| 3618 | 1410 | AUCUGAGGUGACUACCUCAUU |
| 3619 | 1411 | AAUCCCAGUAGACAUCACUAC |
| 3620 | 1412 | AAGUAUUUCUGUAUUGAGAAU |
| 3621 | 1413 | AUUAAUAUUACCGUUUCAUUU |
| 3622 | 1414 | UAUCCUUUGGUUAGAUGGUCU |
| 3623 | 1415 | AGAAGAAUAUUGUCACUCUUU |
| 3624 | 1416 | CUUCUUCUUCUUCUUCCUCUU |
| 3625 | 1417 | UCAUUAGAAAUAAACCCAUUG |
| 3626 | 1418 | UUAUAGACAAAUAUCUCAAAC |
| 3627 | 1419 | AACUGAAAGCAUAAGAGAGAA |
| 3628 | 1420 | AUUUCAGUAUUCUACAUUUAU |
| 3629 | 1421 | AUCAUUUAUAGACAAAUAUCU |
| 3630 | 1422 | UCAUAACUUCUAUUGAAAUUA |
| 3631 | 1423 | CAUAACUCUCCAAUACAGGGA |
| 3632 | 1424 | AAAUAGGUGAUACAUAGGAAA |
| 3633 | 1425 | AUCACAACUACUGCAAACAAC |
| 3634 | 1426 | AUGAAUCGUAUGCUCAAAGUC |
| 3635 | 1427 | UGGAGUUCUAAUAGUGACAUC |
| 3636 | 1428 | UAUUUAUUGUAAAGCAAUAUU |
| 3637 | 1429 | CAAAUGUGAAUCCUUCAGCAU |
| 3638 | 1430 | AUUGCUCUGGAAUUCCAGUGA |
| 3639 | 1431 | AUUUCUGGUUGUUGACUGUUU |
| 3640 | 1432 | GUAUUUAUCCCACUACAUCUG |
| 3641 | 1433 | UUCCCAGUCUUUGUCCAUAUG |
| 3642 | 1434 | CUAAUAGUGACAUCUCCCUAG |
| 3643 | 1435 | UGUUUAAAUGUGGUUUCUCCU |
| 3644 | 1436 | UUCCUCUUGGGUACUAAAUCU |
| 3645 | 1437 | AGCAGUGUACUCAUCAUACAA |
| 3646 | 1438 | UCGUUAUCUCAGGGCACACUA |
| 3647 | 1439 | CUCUACUGUGCUUCUCACCCU |
| 3648 | 1440 | GUAACUAGCAAAUAUCUCUGC |
| 3649 | 1441 | UGGUGAGUUAGAAGGAAGUUA |
| 3650 | 1442 | CAAUGCUUCUUAGCUUCUCUA |
| 3651 | 1443 | AUAAAUAAUUUGUAUCAUAAG |

TABLE 6-continued

Results for PAK3.
Score threshold: 70. Design: siRNA 21 nt.

| SEQ ID NO | siRNA_id | siRNA guide strand/ AS Sequence |
|---|---|---|
| 3652 | 1444 | AAGUUCUGUUUAGAUUCUUUU |
| 3653 | 1445 | CAACGCACUGGAUCCUUGCUA |
| 3654 | 1446 | UGAUUUCAAAGUCAGCUUUUA |
| 3655 | 1447 | UAAAGCACACCACACAAGC |
| 3656 | 1448 | UUGCGGGUCCAUAAAGCACAC |
| 3657 | 1449 | UUUGAGCUUUAUUUAGAUAUA |
| 3658 | 1450 | AUGGAAUAAUUGUAACUAGCA |
| 3659 | 1451 | UUGCUUAACUGAAUAUUAACU |
| 3660 | 1452 | CACAGUUUCAGUUUCAGUGUG |
| 3661 | 1453 | AUCGUGCCCAUUGCUCUGGAA |
| 3662 | 1454 | UCACGGUGGAAGUGACCACUU |
| 3663 | 1455 | CUAAAUCUGUUGAACAUGUUG |
| 3664 | 1456 | AGCAAUUUAGUAAUAAAGCUC |
| 3665 | 1457 | UGGGAUAUGAUUGUAAGUUAA |
| 3666 | 1458 | UAGCAGGCUGAAUUUGCAAGG |
| 3667 | 1459 | UACAGUGCAUAUGUUUCAUAA |
| 3668 | 1460 | UUCAAAUCCCAGGCCCAUCAA |
| 3669 | 1461 | UUCUCCCACCUCAGCCUCCCA |
| 3670 | 1462 | UUAAAGGAGUGUGGAUCAGAA |
| 3671 | 1463 | UAGAUAAAGACCAAGAGAUUC |
| 3672 | 1464 | UCAACAUUGCUGCCCUGUUUG |
| 3673 | 1465 | UCCAUAAAGCACACCACACAC |
| 3674 | 1466 | UGCAACUCUAUUAGGGCAUGG |
| 3675 | 1467 | AUGUUUACUAUAUCACCUUUC |
| 3676 | 1468 | UGAAGGUUCAUCUGCUUUAUG |
| 3677 | 1469 | UAGUUGUAAUCCCUGUUUAUG |
| 3678 | 1470 | GAUCUUAUCAUCAAUAAUGAA |
| 3679 | 1471 | AUGGAGAGGUUAAGUGACUUG |
| 3680 | 1472 | UAUGGAAUAAUUGUAACUAGC |
| 3681 | 1473 | AUGCAUGGGCUCUGCUAUCUU |
| 3682 | 1474 | UCGAUUGUACCAAAUGUGAAU |
| 3683 | 1475 | CAUAUCUGAGGUGACUACCUC |
| 3684 | 1476 | AAGAACUAAGCAUGAACACAC |
| 3685 | 1477 | UUUAUCCCACUACAUCUGACU |
| 3686 | 1478 | AUUCCAUGACUACCCAUAGUU |
| 3687 | 1479 | UAAACACAUUCCCAAUGCAUG |
| 3688 | 1480 | AUUCAUUUGAAAGGUAAAGAA |
| 3689 | 1481 | AUAGGAGAAAUAUUCCAUUAU |
| 3690 | 1482 | UCUUAGCGGCUGCUGUUCUUA |
| 3691 | 1483 | UAUGCUUCAAAUUAAUAUUAC |
| 3692 | 1484 | UGGAUGGUUAGAUGGAUGGAU |
| 3693 | 1485 | AAAGAACUAAGCAUGAACACA |
| 3694 | 1486 | AAGGAGGUUUGAAUGCAAGAG |
| 3695 | 1487 | UCUAUGGAUCACCUGGUUUGA |
| 3696 | 1488 | AUGGAUGGUUAGAUGGAUGGA |
| 3697 | 1489 | ACACACCAUAUUCCGAAACAG |
| 3698 | 1490 | AUGGUUAGAUGGAUGGAUGUA |
| 3699 | 1491 | AGAUACAAUUCUGAUAAACAA |
| 3700 | 1492 | AGUAGCUAUCUAAAUAAUUAA |
| 3701 | 1493 | UCCACAUGCAAAUACACGUUC |
| 3702 | 1494 | AGUUACAGAAGAAUUUCACUA |
| 3703 | 1495 | UUGAAUGCAAGAGGGACUACU |
| 3704 | 1496 | CAGGAUUCUGUGAAGAUCUUA |
| 3705 | 1497 | CUGAACACACAUAUUCCCUCUC |
| 3706 | 1498 | ACUCAAGACACAGUCAUGCAC |
| 3707 | 1499 | AUUAUAACAAUAUCAAAUAAA |
| 3708 | 1500 | UCUUUCAGGUAUUAAGGAGAU |
| 3709 | 1501 | UCCCAUCUUUGUUUAAAUGUG |
| 3710 | 1502 | AAUUGUAACUAGCAAAUAUCU |
| 3711 | 1503 | AACUAGCAGCAUAUCUGAGG |
| 3712 | 1504 | AGAUGUAAGGAUCAGGUGGUU |
| 3713 | 1505 | AAUUAGUGGGACUUGCCCUAU |
| 3714 | 1506 | AGUUUGGAGUAAUCGUGCCCA |
| 3715 | 1507 | CAAAUCUUGGUACAAAGUGGU |
| 3716 | 1508 | ACUUUGCUCAGGAGUGAUCUG |
| 3717 | 1509 | UCUUCAAAGUGAAUGCACAAA |
| 3718 | 1510 | AUUAUUUCCAAGUUCCCAUUU |
| 3719 | 1511 | UCAACAUUUCUCAAUGCUAAU |
| 3720 | 1512 | AGGAGGUCAAGCCUCUCCCAA |
| 3721 | 1513 | AGUAGACAUCACUACCCUGUG |
| 3722 | 1514 | UGACAGGAUUUCACCGUUUGA |
| 3723 | 1515 | UCUUCCUAGGCUAGUAUUUAU |
| 3724 | 1516 | UCAACAUGUAAGGGAUGCUAA |
| 3725 | 1517 | CAUCUUCUUCUUCUUCUUCCU |

TABLE 6-continued

Results for PAK3.
Score threshold: 70. Design: siRNA 21 nt.

| SEQ ID NO | siRNA_id | siRNA guide strand/ AS Sequence |
|---|---|---|
| 3726 | 1518 | UAAUAGUGACAUCUCCCUAGC |
| 3727 | 1519 | GCUUAGAGAAACAACUUUCUG |
| 3728 | 1520 | CAUCUAGAACAGCUUGUGGGU |
| 3729 | 1521 | UCUUCAUCUUCUUCUUCAGAC |
| 3730 | 1522 | AAAUGCUACAAGUUGUAUAGA |
| 3731 | 1523 | UUUGGUUCCCAACAAAUUAAU |
| 3732 | 1524 | UAUCAACUUUCGGACCAUAAG |
| 3733 | 1525 | AAGCUUGCAGGCACUCUCUGC |
| 3734 | 1526 | CUAUGUAUCCAUGUGCACUUU |
| 3735 | 1527 | AUGGGAUAGCAUUUGCCUGAU |
| 3736 | 1528 | UAAAGCCUAUGGAAUAAUUGU |
| 3737 | 1529 | UAGCUGGGAUUACAGGCGCCC |
| 3738 | 1530 | UCAGGAGUGAUCUGGGCACAG |
| 3739 | 1531 | AGUGCUUCGUUUACUUUGCUC |
| 3740 | 1532 | UCGUUUACUUUGCUCAGGAGU |
| 3741 | 1533 | UCACUCUUAGCAGUCUCAGCC |
| 3742 | 1534 | UAUGAGGAUUUCCUAGGUUCA |
| 3743 | 1535 | UAAUUUGUAUCAUAAGUAAAU |
| 3744 | 1536 | AUUAAUGUAUCUAUUUCCUCC |
| 3745 | 1537 | ACACAACACUAUGAAGAGGGA |
| 3746 | 1538 | AAAUGAAUUGGAAGGCUGCCA |
| 3747 | 1539 | AAGUAGCUGGGAUUACAGGCG |
| 3748 | 1540 | CAUCUAUGACAAUGCAAGUG |
| 3749 | 1541 | UCUAUGUUGGUCAGGCUGGUC |
| 3750 | 1542 | CUGAGUUCACUUCAAAUCCCA |
| 3751 | 1543 | UCAGAGAAAGUCCCAUCUUUG |
| 3752 | 1544 | AUCCUCAGUGGAGGAGCCGGG |
| 3753 | 1545 | AAGCAAUUUCGUGUUUCUUUU |
| 3754 | 1546 | AUGAGAUACAAUUCUGAUAAA |
| 3755 | 1547 | UACAUAAUCUGAGGGAGUAGG |
| 3756 | 1548 | UCUUUGGUUCCCAACAAAUUA |
| 3757 | 1549 | UGAAGAUCUUAUCAUCAAUAA |
| 3758 | 1550 | AUAUUGUCACUCUUUAUAUCU |
| 3759 | 1551 | UGGUUUACAGAUAACACAUUC |
| 3760 | 1552 | UCUUCUUCUUCCUCUUCAUCU |
| 3761 | 1553 | CUGUCGGACUGACAUUUCUUG |
| 3762 | 1554 | CUCCUCAUUGUUAAUAUGCUG |
| 3763 | 1555 | AAAGAAAUCUGAAUAACAUAA |
| 3764 | 1556 | GACACAGUCACUAAUGUACUG |
| 3765 | 1557 | UGGGUUCAAGCGAUUCUCCCA |
| 3766 | 1558 | AACCAUACCAUCAGCAGGUCU |
| 3767 | 1559 | GUAUAACAUAGUAUGCUUCAA |
| 3768 | 1560 | AUACUUUAGGUCCAAGUUUCA |
| 3769 | 1561 | ACAUGGUGACUGAUUUGAGGG |
| 3770 | 1562 | UGUUUAGGUUCACUCUUAGCA |
| 3771 | 1563 | AGAAGGAAGUUAUCCUUUGGU |
| 3772 | 1564 | ACUAAUGAAUAGGGCUUCCUA |
| 3773 | 1565 | UCCAUGACUACCCAUAGUUCA |
| 3774 | 1566 | AAGGAAGAGAGAUCUCUGGGC |
| 3775 | 1567 | UCUAAAGAAAGUGCUUUCAUU |
| 3776 | 1568 | CUGAAUGUACAUAAGUUCUGU |
| 3777 | 1569 | UGUACAAAGUACUGGAAUUGG |
| 3778 | 1570 | GUGUACUCAUCAUACAACUGG |
| 3779 | 1571 | UCCAGAAAGGCAAUAUCUGCA |
| 3780 | 1572 | AAUAUGGUAUUUGCGGGUCCA |
| 3781 | 1573 | AAUAGAUAUAUGGUGAAAUAG |
| 3782 | 1574 | AUUUCCUUCCCAGUCCACAUG |
| 3783 | 1575 | CAGACUUUACAUACAGACUGU |
| 3784 | 1576 | CUUACUGCUGGUAUUAUGGGA |
| 3785 | 1577 | UCAUAAGUAAAUGAUGAUUAA |
| 3786 | 1578 | UCUGUCCUUCAUCCAUACAGG |
| 3787 | 1579 | UGACUUGCCUAGCGUCACAUA |
| 3788 | 1580 | CAUCUGACUCAUUCUCUACUA |
| 3789 | 1581 | AUGAGGGAGAUGGUGAGGUGU |
| 3790 | 1582 | GUACACUAUAUAGUUUGCUGA |
| 3791 | 1583 | UUUCACUCUUGUUGCCGAGGC |
| 3792 | 1584 | UACUGCAAACAACCUAUAAAU |
| 3793 | 1585 | CAACUGAUUUCAAUUAUCUGU |
| 3794 | 1586 | ACAUUGUUUAAUAUUAAACAC |
| 3795 | 1587 | CAGUUAUACAGACAACAGGAA |
| 3796 | 1588 | UUUGCAUCCCAGGAUUUCAUU |
| 3797 | 1589 | UAUCAUUUAUAGACAAAUAUC |
| 3798 | 1590 | UCCCACUACAUCUGACUCAUU |
| 3799 | 1591 | UACAGGCCCAGAUUCGUUUUU |

TABLE 6-continued

Results for PAK3.
Score threshold: 70. Design: siRNA 21 nt.

| SEQ ID NO | siRNA_id | siRNA guide strand/ AS Sequence |
|---|---|---|
| 3800 | 1592 | UCUACUCUCAGAAGAUUCAGG |
| 3801 | 1593 | AUUUCAGUCUUACUCAUGAGG |
| 3802 | 1594 | GAAACUAAGCAGCAUAUCUGA |
| 3803 | 1595 | AAGGAAGUUAUCCUUUGGUUA |
| 3804 | 1596 | CUUCUUCAGACACAGGAGGGG |
| 3805 | 1597 | UUAGCGGCUGCUGUUCUUAAU |
| 3806 | 1598 | UUUCACUACACAUGGUUUACA |
| 3807 | 1599 | UGGAACAUGGACACACAAAUA |
| 3808 | 1600 | AUGUCACAGUUUCAGUUUCAG |
| 3809 | 1601 | UUAAUCCAAAGUUACAGAAGA |
| 3810 | 1602 | UCUCCCACCUCAGCCUCCCAA |
| 3811 | 1603 | AAUAGGGCUUCCUAACCAGGU |
| 3812 | 1604 | AGCACAUGGAGACCAUCCCAA |
| 3813 | 1605 | UGCAACUUGUAAGUGUUUAGG |
| 3814 | 1606 | AAGAGACUCAGGCUUAAACGU |
| 3815 | 1607 | AAUAAAGCUCAUAUUAGACUC |
| 3816 | 1608 | UAGCUAUCUAAAUAAUUAACA |
| 3817 | 1609 | AUGCUGAACUGAAAGCAUAAG |
| 3818 | 1610 | AUGAGUAUAAUCCCAGUAGAC |
| 3819 | 1611 | ACUAAGCAUGAACACACCAUA |
| 3820 | 1612 | AGUGCAGGAAAUCCAAAGCUU |
| 3821 | 1613 | UGAUAUCUCAGUUCCCGCAUU |
| 3822 | 1614 | AAUAUUAUAACAAUAUCAAAU |
| 3823 | 1615 | AGUAAUAUCCUGUUGGACAAG |
| 3824 | 1616 | AAUGCUGAAUUUCAGUCCUCU |
| 3825 | 1617 | UCCUCAUUGUUAAUAUGCUGA |
| 3826 | 1618 | UGCAAAGUAUAACAUAGUAUG |
| 3827 | 1619 | CAGACAGCUGCUAUCUGUCCU |
| 3828 | 1620 | AUAGUUCCCUUUCUGCUGUUU |
| 3829 | 1621 | CAGGACACAGUCACUAAUGUA |
| 3830 | 1622 | ACAUAACUCUCCAAUACAGGG |
| 3831 | 1623 | UAUUCAUUUGGUCACUUAAAG |
| 3832 | 1624 | UAUCUGCAACAGAUGUUAUCA |
| 3833 | 1625 | AGAAAUAUUCCAUUAUUUCCA |
| 3834 | 1626 | UGAGGUGUAAGGCUUGCAGUC |
| 3835 | 1627 | UGCCCUAUUCCUAACUCAGGA |
| 3836 | 1628 | UUUCCAGCAGUGUACUCAUCA |
| 3837 | 1629 | AAAGAAAGUGCUUUCAUUUUA |
| 3838 | 1630 | AUCUAAUGACAAUGCAAGUGA |
| 3839 | 1631 | AACUAAUGAAUAGGGCUUCCU |
| 3840 | 1632 | CCUUCUAUAACACAAAUUGUU |
| 3841 | 1633 | UCCAUCUCAAGACAGCGAUUU |
| 3842 | 1634 | AUAUUCCAUUAUUUCCAAGUU |
| 3843 | 1635 | UCACAUUGGGUAAGGAGUUUU |
| 3844 | 1636 | ACCAUAAAUACCUUUAAUCCA |
| 3845 | 1637 | GUGAUCUGGGCACAGAACCCA |
| 3846 | 1638 | AAAGUGCUGGGAUUACAGGUA |
| 3847 | 1639 | AAGAAAUCUGAAUAACAUAAA |
| 3848 | 1640 | AUUGAUUGGGAUGUAGCCUUC |
| 3849 | 1641 | ACUCGUACACACAGGUGUGCA |
| 3850 | 1642 | AUGUGGUUUCUCCUAUGAGGA |
| 3851 | 1643 | UACAUACAGACUGUAUGGAAA |
| 3852 | 1644 | UAUUUCCUUCCCAGUCCACAU |
| 3853 | 1645 | AACUGUCAGUUUACAAAUGCU |
| 3854 | 1646 | AGGUGUAAGGCUUGCAGUCUU |
| 3855 | 1647 | GACACAGUCAUGCACAAUCCA |
| 3856 | 1648 | AGGAGAUUAACAACCUGGUUU |
| 3857 | 1649 | AGAAACAACUUUCUGUAAUUU |
| 3858 | 1650 | UGCUGUAGGCAGGGCAUUGGG |
| 3859 | 1651 | UGUGCCCUCGUUAUCUCAGGG |
| 3860 | 1652 | ACAUAGUUGUAAUCCCUGUUU |
| 3861 | 1653 | UCAGCAAGAACGAAGUCAUUA |
| 3862 | 1654 | AGACAUUUAUGAAUAUGCUUU |
| 3863 | 1655 | UCCAACAAGGAUUUCAGUAUU |
| 3864 | 1656 | AGCAAUUCGUGUUUCUUUUU |
| 3865 | 1657 | UUCCAUCUUUCCUGCAGCAGA |
| 3866 | 1658 | AAUUUCAAGACAUUUAUGAAU |
| 3867 | 1659 | UUCUAAUACUUAUUAGAAAUA |
| 3868 | 1660 | CUUCUUCCUCUUCAUCUUCUU |
| 3869 | 1661 | UCACUACACAUGGUUUACAGA |
| 3870 | 1662 | UCAACCUGAGAGCUGUUAAA |
| 3871 | 1663 | UUCCAUGACUACCCAUAGUUC |
| 3872 | 1664 | UGGAUGCUGAGGUCAGAAGGA |
| 3873 | 1665 | ACACAGUACUUGCUCUGGUAU |

TABLE 6-continued

Results for PAK3.
Score threshold: 70. Design: siRNA 21 nt.

| SEQ ID NO | siRNA_id | siRNA guide strand/ AS Sequence |
|---|---|---|
| 3874 | 1666 | UUAUCAAAUCUUGGUACAAAG |
| 3875 | 1667 | AUAAAUAGAUAUAUGGUGAAA |
| 3876 | 1668 | CUUCUUCUUCCUCUUCAUCUU |
| 3877 | 1669 | UGCUUCAAAUUAAUAUUACCG |
| 3878 | 1670 | AUAUACAUAACUCUCCAAUAC |
| 3879 | 1671 | UAAUUCCACCACCCUAACACA |
| 3880 | 1672 | AAGGCAAUAUCUGCAACAGAU |
| 3881 | 1673 | UGUUUAAUGAUUUCAAAGUCA |
| 3882 | 1674 | UGAUGUAAAGCUCAUGUAUUU |
| 3883 | 1675 | AUACCAUCAGCAGGUCUACAA |
| 3884 | 1676 | UGACACACACGAGAUCAGC |
| 3885 | 1677 | CUUCUUUCUAAUACUUAUUAG |
| 3886 | 1678 | AAUUUGAGAACAUCUAGAACA |
| 3887 | 1679 | AGCAGGAUGUCACAGUUUCAG |
| 3888 | 1680 | CACGAGAUCAGCAAGAACAA |
| 3889 | 1681 | UCUUGUUCAGAGCUCAGAGAC |
| 3890 | 1682 | UUCUCACCCUUCCCUGACUUU |
| 3891 | 1683 | CUGAAUAUUAACUGCAAGUAG |
| 3892 | 1684 | AAUGUACAUAAGUUCUGUUUA |
| 3893 | 1685 | UACUUUGCUCAGGAGUGAUCU |
| 3894 | 1686 | UGGGCGCUCUUUCUCCUUCUU |
| 3895 | 1687 | UCCCAGUUUACCCUCUUUCCA |
| 3896 | 1688 | CACAACUACUGCAAACAACCU |
| 3897 | 1689 | UGCAGUCUUAGCGGCUGCUGU |
| 3898 | 1690 | ACUGAAUAUUAACUGCAAGUA |
| 3899 | 1691 | UCACUUCAAAUCCCAGGCCCA |
| 3900 | 1692 | AGGGAUAGAUGUAAGGAUCAG |
| 3901 | 1693 | UUGGAGUAAUCGUGCCCAUUG |
| 3902 | 1694 | UCUGAAUAACAUAAAGAAUAA |
| 3903 | 1695 | UGAGCAAAGGAAUAUAAUUAU |
| 3904 | 1696 | UGAGGUGACUACCUCAUUAUU |
| 3905 | 1697 | AGAGACAGUCCUACAUAUUUG |
| 3906 | 1698 | UUUCUCCUAUGAGGAUUUCCU |
| 3907 | 1699 | UGUUCAGAGCUCAGAGACUGG |
| 3908 | 1700 | UGUAUAAACAGUACCUGAUGC |
| 3909 | 1701 | UGUUAUGAGUAUAAUCCCAGU |
| 3910 | 1702 | UGACUACCCAUAGUUCAUCAC |
| 3911 | 1703 | UCUCAGCUCACCACAACCUCC |
| 3912 | 1704 | UUUAGGUCCAAGUUUCAAACU |
| 3913 | 1705 | AGAGAAAGUCCCAUCUUUGUU |
| 3914 | 1706 | AAAGUUACAGAAGAAUUUCAC |
| 3915 | 1707 | UCCUCAGUGGAGGAGCCGGGG |
| 3916 | 1708 | AUAAAGCUCAUAUUAGACUCC |
| 3917 | 1709 | UAUCAAAUCUUGGUACAAAGU |
| 3918 | 1710 | UUAUUAAAGUUCUCACCUAAA |
| 3919 | 1711 | UCAGUCCUCUUGUUCAGAGCU |
| 3920 | 1712 | UCACCUGGUUUGAGUGCAGGA |
| 3921 | 1713 | CAUCUUCUUCUUCAGACACAG |
| 3922 | 1714 | UUCCCUGACUUUCCCACUGCC |
| 3923 | 1715 | GAAUCGUAUGCUCAAAGUCUG |
| 3924 | 1716 | UCAAGCGAUUCUCCCACCUCA |
| 3925 | 1717 | ACAGUCACUAAUGUACUGAUU |
| 3926 | 1718 | UAACCAACAGAAAGAUUAUAU |
| 3927 | 1719 | GUUCACUCUUAGCAGUCUCAG |
| 3928 | 1720 | AACAUAGUAUGCUUCAAAUUA |
| 3929 | 1721 | AAGCCUUCUAUAACACAAAUU |
| 3930 | 1722 | AUGUUGGGUUAUAUUCAUUUG |
| 3931 | 1723 | AAAGGAGAAGCUCAAGUACAG |
| 3932 | 1724 | CUUCUUCUUCAGACACAGGAG |
| 3933 | 1725 | CUUCCUCUUCAUCUUCUUCUU |
| 3934 | 1726 | AACAGAAAUAGGUGAUACAUA |
| 3935 | 1727 | UCACAGGAAAGGAGAAGCUCA |
| 3936 | 1728 | UAACUAAUGAAUAGGGCUUCC |
| 3937 | 1729 | AUCCUUUGGUUAGAUGGUCUC |
| 3938 | 1730 | UCCCAUUUCUUACAGAGUUGA |
| 3939 | 1731 | AGUGGUAGUAAAGAAGUACCU |
| 3940 | 1732 | AUUUCAGUCCUCUUGUUCAGA |
| 3941 | 1733 | UGGGAUGUAGCCUUCACUGAC |
| 3942 | 1734 | AUACCUUUGCUUAACUGAAUA |
| 3943 | 1735 | CACUCUUAGCAGUCUCAGCCA |
| 3944 | 1736 | CUUCAUUAUCCAGACCGUCAG |
| 3945 | 1737 | AUAUUAAACACAUUCCCAAUG |
| 3946 | 1738 | ACUCUUGUUGCCGAGGCUGGA |
| 3947 | 1739 | GACUCAUUCUCUACUAUCGCU |

TABLE 6-continued

Results for PAK3.
Score threshold: 70. Design: siRNA 21 nt.

| SEQ ID NO | siRNA_id | siRNA guide strand/ AS Sequence |
|---|---|---|
| 3948 | 1740 | CUAUGGAAUAAUUGUAACUAG |
| 3949 | 1741 | UCGUAUGCUCAAAGUCUGAAG |
| 3950 | 1742 | AUCUUUCCUGCAGCAGAGUUU |
| 3951 | 1743 | AUGCAAGAGGGACUACUCUCU |
| 3952 | 1744 | CUUCUUCUUCUUCCUCUUCAU |
| 3953 | 1745 | UAAUAAAGCUCAUAUUAGACU |
| 3954 | 1746 | UGAGAAUUAAACUCUAGAAAG |
| 3955 | 1747 | AAGAGGGAGUGUGCAUCUUUG |
| 3956 | 1748 | AUGAUUAAUGUAUCUAUUUCC |
| 3957 | 1749 | UAUUUGCGGGUCCAUAAAGCA |
| 3958 | 1750 | AACUUGUAAGUGUUUAGGUUC |
| 3959 | 1751 | UUGUAAGUGUUUAGGUUCACU |
| 3960 | 1752 | CUCUUGGGUACUAAAUCUGUU |
| 3961 | 1753 | GUUAAGUGACUUGCCUAGCGU |
| 3962 | 1754 | AAGGAGAAGCUCAAGUACAGU |
| 3963 | 1755 | AUACAAUUCUGAUAAACAAUG |
| 3964 | 1756 | AAAGCACACCACACACAAGCA |
| 3965 | 1757 | ACCACUUUAUGGUCACUUCAA |
| 3966 | 1758 | AGUCUCCUAAGAAAGCGUGUG |
| 3967 | 1759 | AAGUGCUGGGAUUACAGGUAU |
| 3968 | 1760 | CAGUCAUUUAACAGAGCCAU |
| 3969 | 1761 | UAUCCACAUCCAUCUCAAGAC |
| 3970 | 1762 | AGUCAUAUAAGGAAUUCUGUC |
| 3971 | 1763 | ACAAGCCUGAAAGAAAUCUGA |
| 3972 | 1764 | ACAUAUUCCUCUCCACUUUUG |
| 3973 | 1765 | ACUGCUGGUGAAGCAAUGGAU |
| 3974 | 1766 | GUGUCUAUAGUUCCCUUUCUG |
| 3975 | 1767 | UUCUUGGGAUAUGAUUGUAAG |
| 3976 | 1768 | ACUAAGCAGCAUAUCUGAGGU |
| 3977 | 1769 | AAUGCAAGAGGGACUACUCUC |
| 3978 | 1770 | UUCUUUCAUAGGAGAAAUAUU |
| 3979 | 1771 | GACAACAGGAAGCAAUUUCGU |
| 3980 | 1772 | UUUCAGUAUUCUACAUUUAUC |
| 3981 | 1773 | UUUGCAAGGCAACCUAUAAUG |
| 3982 | 1774 | UCAGGCUUAAACGUGAUAUUU |
| 3983 | 1775 | GUAAUCGUGCCCAUUGCUCUG |
| 3984 | 1776 | AGUUAUACAGACAACAGGAAG |
| 3985 | 1777 | ACAGAACCCAAAGUCAGUCAA |
| 3986 | 1778 | GAAACUCUAAAGAAAGUGCUU |
| 3987 | 1779 | UCCUGUACAAAGUACUGGAAU |
| 3988 | 1780 | UCAUAGAAUUUGAGAACAUCU |
| 3989 | 1781 | AUUAUCAAAUCUUGGUACAAA |
| 3990 | 1782 | UUACAAAUAAAUUACAUAAUC |
| 3991 | 1783 | UGAAUAUGGUAUUUGCGGGUC |
| 3992 | 1784 | ACUUAUUAGAAAUAUACAUAA |
| 3993 | 1785 | CAUUUAUGACAAAUAUCUCA |
| 3994 | 1786 | AAUAUUGUCACUCUUUAUAUC |
| 3995 | 1787 | UGGACUUCCACAUGUUCACAC |
| 3996 | 1788 | ACAUAAAGAAUAAAUACUUGA |
| 3997 | 1789 | AGCUAUCUAAAUAAUUAACAA |
| 3998 | 1790 | ACAAAUAUUUACAAUGACACA |
| 3999 | 1791 | GUUGUUGACUGUUUCUUUGGA |
| 4000 | 1792 | AGGCUGGUCUCGAACUCCUGA |
| 4001 | 1793 | CUGUUGCAAUGUCUAGUGCUG |
| 4002 | 1794 | UUGCUUCAACCACAAUUUAAA |
| 4003 | 1795 | AUUCACAUAAUUCCACCACCC |
| 4004 | 1796 | UUGGGACCAUCCACUAACUCC |
| 4005 | 1797 | UCCUCUUGUUCAGAGCUCAGA |
| 4006 | 1798 | AGACGAAGUUUCACUCUUGUU |
| 4007 | 1799 | CAAUACUUUAGGUCCAAGUUU |
| 4008 | 1800 | UGCUCAGGAGUGAUCUGGGCA |
| 4009 | 1801 | CAAGAGACCAGAUAUCAACUU |
| 4010 | 1802 | CUGUCCUUCAUCCAUACAGGU |
| 4011 | 1803 | UAAUACUUAUUAGAAAUAUAC |
| 4012 | 1804 | UAAUUCCAAGAGACCAGAUAU |
| 4013 | 1805 | UUUCCUUCCCAGUCCACAUGC |
| 4014 | 1806 | UAAUCUGAGGGAGUAGGAAAA |
| 4015 | 1807 | UUGGGUUGCUGUUGAAGGUUC |
| 4016 | 1808 | AGAUAUGGUGAAAUAGUAG |
| 4017 | 1809 | AGGAUUUCAGUAUUCUACAUU |
| 4018 | 1810 | CAAUAUUAUAACAAUAUCAAA |
| 4019 | 1811 | GUUUAGGUUCACUCUUAGCAG |
| 4020 | 1812 | UCUAGAACAGCUUGUGGGUUC |
| 4021 | 1813 | UAUAAGGAAUUCUGUCGGACU |

TABLE 6-continued

Results for PAK3.
Score threshold: 70. Design: siRNA 21 nt.

| SEQ ID NO | siRNA_id | siRNA guide strand/ AS Sequence |
|---|---|---|
| 4022 | 1814 | AUGGAGGUGAUAUCUCAGUUC |
| 4023 | 1815 | ACUAUGAAGAGGGAGUGUGCA |
| 4024 | 1816 | UGUGGUUGAGUGCUGAAGAAU |
| 4025 | 1817 | AAACACAUUCCCAAUGCAUGU |
| 4026 | 1818 | UAUCUUUGGUUCCCAACAAAU |
| 4027 | 1819 | AAGCCUAUGGAAUAAUUGUAA |
| 4028 | 1820 | AAUGACACACACACGAGAUCA |
| 4029 | 1821 | CUUCCAUCUUUCCUGCAGCAG |
| 4030 | 1822 | AUAAAUACUUGAGUUAAAUCU |
| 4031 | 1823 | UCCUUCUUCCUAGGCUAGUAU |
| 4032 | 1824 | UCAUUACCAGACCGUCAGAC |
| 4033 | 1825 | UGGGAUAGCAUUUGCCUGAUG |
| 4034 | 1826 | UCCUUUGCAGCGAUAAUCAGA |
| 4035 | 1827 | UUUAUAUCUCUAUGGAUCACC |
| 4036 | 1828 | GAAGUUUCACUCUUGUUGCCG |
| 4037 | 1829 | CAUCUUUGUUUAAAUGUGGUU |
| 4038 | 1830 | ACACUAUGAAGAGGGAGUGUG |
| 4039 | 1831 | AUGCACAAUCCAUAUUUCAAU |
| 4040 | 1832 | CUGUUCUUAAUUGCUUCCUUU |
| 4041 | 1833 | CUUUGCUCAGGAGUGAUCUGG |
| 4042 | 1834 | UACAGGAUUCUGUGAAGAUCU |
| 4043 | 1835 | AAAUACCUUUAAUCCAAAGUU |
| 4044 | 1836 | AGCUCUAUUAGACUCCGGGG |
| 4045 | 1837 | AACUGCAAGUAGCUUAGAUAA |
| 4046 | 1838 | AACAACUUUCUGUAAUUUACA |
| 4047 | 1839 | UAACAACAUUAACGUUCUUUC |
| 4048 | 1840 | CAUGGUGACUGAUUUGAGGGG |
| 4049 | 1841 | UUUGCGGGUCCAUAAAGCACA |
| 4050 | 1842 | AGUGCUGUAUAAACAGUACCU |
| 4051 | 1843 | UGAAGGAGGUUUGAAUGCAAG |
| 4052 | 1844 | UUGCUUCCUUUGCAGCGAUAA |
| 4053 | 1845 | UCUCUACAUCGCUGUUGAUU |
| 4054 | 1846 | AUAGGUGAUACAUAGGAAAAA |
| 4055 | 1847 | AUUCAACCUGAGAGUCUGUUA |
| 4056 | 1848 | AUUCUGUCGGACUGACAUUUC |
| 4057 | 1849 | GUAGACAUCACUACCCUGUGA |
| 4058 | 1850 | AGAUGGUCUCCCUUGCUCUUU |
| 4059 | 1851 | UCCCACCAUAGUGCUUCGUUU |
| 4060 | 1852 | UGUACCAAAUGUGAAUCCUUC |
| 4061 | 1853 | UGGUAUUAUGGGAUAGCAUUU |
| 4062 | 1854 | AAUAUUAGGGUUCUUAUUUUC |
| 4063 | 1855 | UCAGGCUGGAGAGAGGCUUGG |
| 4064 | 1856 | GUAGCUACAGGAUUCUGUGAA |
| 4065 | 1857 | UCUCCUAAGAAAGCGUGUGCC |
| 4066 | 1858 | CACUCUUUAUAUCUCUAUGGA |
| 4067 | 1859 | ACAACCUCCGCCUCCUGGGUU |
| 4068 | 1860 | UGACCUCCCAUUUCUUACAGA |
| 4069 | 1861 | ACAACGCACUGGAUCCUUGCU |
| 4070 | 1862 | UAUGGUAUUUGCGGGUCCAUA |
| 4071 | 1863 | CUUGGUGCGAUAACUGGUGGU |
| 4072 | 1864 | CUCUUCAUUAUCCAGACCGUC |
| 4073 | 1865 | CUCCUCAUCUGUCAUCUUGGA |
| 4074 | 1866 | UCUUUCCUGCAGCAGAGUUUU |
| 4075 | 1867 | UAUCAUCAAUAAUGAAUAUGG |
| 4076 | 1868 | ACACUAGCAACAUCAAAGAUU |
| 4077 | 1869 | CACACAGUACUUGCUCUGGUA |
| 4078 | 1870 | AUUCCUAACUCAGGACAUUUU |
| 4079 | 1871 | UCCUGACCUCAGGUGAUCCGC |
| 4080 | 1872 | UCAACCACAGAACGAGUAUAG |
| 4081 | 1873 | ACAAACACAACACUAUGAAGA |
| 4082 | 1874 | AGAUUCAGUUAGACAUUGUUU |
| 4083 | 1875 | UCCACUGGAGAGAAUUUCAAG |
| 4084 | 1876 | ACUAACUCCCAGUUUACCCUC |
| 4085 | 1877 | CACACAGGUGUGCACAUGGAG |
| 4086 | 1878 | CCAGACUUUACAUACAGACUG |
| 4087 | 1879 | AUCACCUGGUUUGAGUGCAGG |
| 4088 | 1880 | AAAGACCAAGAGAUUCAACCG |
| 4089 | 1881 | CUGCAGACAGCUGCUAUCUGU |
| 4090 | 1882 | AUUUCCUCCUGGUAUGCCUAU |
| 4091 | 1883 | AUGUUUCAUAAGCACAAGAGA |
| 4092 | 1884 | UUCCCAAUGCAUGUUGGGUUA |
| 4093 | 1885 | ACAUGGACACACAAAUAUUUA |
| 4094 | 1886 | GAACACACAUAUUCCUCUCCA |
| 4095 | 1887 | UCUUUGAGCUGAGAAAUAUCA |

TABLE 6-continued

Results for PAK3.
Score threshold: 70. Design: siRNA 21 nt.

| SEQ ID NO | siRNA_id | siRNA guide strand/ AS Sequence |
|---|---|---|
| 4096 | 1888 | AGAAGAAUUUCACUACACAUG |
| 4097 | 1889 | UAUCCUGUUGGACAAGAAAAU |
| 4098 | 1890 | AGGAAGAGAGAUCUCUGGGCG |
| 4099 | 1891 | CAGCUGACAGUCUCUCAGGAU |
| 4100 | 1892 | CCUAAGGAUCAUCUAGUCCAA |
| 4101 | 1893 | UGUUAAUAUGCUGAACUGAAA |
| 4102 | 1894 | UCACCCACCAAGUAGCUAUCU |
| 4103 | 1895 | UCCCAGUAGACAUCACUACCC |
| 4104 | 1896 | AUAAGAAGUUUCUAUUCAUUU |
| 4105 | 1897 | ACAGAACGAGUAUAGAUUGAU |
| 4106 | 1898 | AUGGGCUCUGCUAUCUUGUGC |
| 4107 | 1899 | CUAAGGAUCAUCUAGUCCAAU |
| 4108 | 1900 | UAUUUCCAAGUUCCCAUUUAU |
| 4109 | 1901 | AUCCAGACCGUCAGACAUUUU |
| 4110 | 1902 | CAUCCAUCUCAAGACAGCGAU |
| 4111 | 1903 | AUUUGCAUCCCAGGAUUUCAU |
| 4112 | 1904 | AUCAAUAAUGAAUAUGGUAUU |
| 4113 | 1905 | UUCAUUUGAAAGGUAAAGAAC |
| 4114 | 1906 | AUCAGAGGAGUCAGGCUGGAG |
| 4115 | 1907 | AUGGUCUCCCUUGCUCUUUAA |
| 4116 | 1908 | UGGUGCGAUAACUGGUGGUGG |
| 4117 | 1909 | ACAAUGCUUCUUAGCUUCUCU |
| 4118 | 1910 | AAGCAUGAACACACCAUAUUC |
| 4119 | 1911 | UAAGGCCUCUCUCUCUCAUUA |
| 4120 | 1912 | UGCAAGGCAACCUAUAAUGCC |
| 4121 | 1913 | UUCAUUGAAUUUCCCGGCACU |
| 4122 | 1914 | AGGCUUGCAGUCUUAGCGGCU |
| 4123 | 1915 | AGGAAUAUAAUUAUUUACACG |
| 4124 | 1916 | AUUCAACCACAGAACGAGUAU |
| 4125 | 1917 | ACAGCUUGUGGGUUCUUCUUC |
| 4126 | 1918 | CUGCUAUCUGUCCUUCAUCCA |
| 4127 | 1919 | CUGAACAUAAACACGUACACU |
| 4128 | 1920 | AAUUCCUUCUUGGGUUGCUGU |
| 4129 | 1921 | UGAACACACCAUAUUCCGAAA |
| 4130 | 1922 | AAGUCAUAACUUCUAUUGAAA |
| 4131 | 1923 | AUCAACAUUGAAAGAUGUGCC |
| 4132 | 1924 | AUCAUAGAAUUUGAGAACAUC |
| 4133 | 1925 | GAACAUAAACACGUACACUAU |
| 4134 | 1926 | UACUGCUGGUAUUAUGGGAUA |
| 4135 | 1927 | UGGUGAGGUGUAAGGCUUGCA |
| 4136 | 1928 | GAAUAUAAUUAUUUACACGAU |
| 4137 | 1929 | AUAGCAGGCUGAAUUUGCAAG |
| 4138 | 1930 | GUCGGACUGACAUUUCUUGGG |
| 4139 | 1931 | CUUGAGAAUUAAACUCUAGAA |
| 4140 | 1932 | AGAUGGUGAGGUGUAAGGCUU |
| 4141 | 1933 | AUAACAUAAAGAAUAAAUACU |
| 4142 | 1934 | CACAUGGAGGUGAUAUCUCAG |
| 4143 | 1935 | CCAUAGUUCAUCACCCACCAA |
| 4144 | 1936 | AAGAUGUGGAUAUAUGGAUGG |
| 4145 | 1937 | UUAGAAAUAAACCCAUUGAGC |
| 4146 | 1938 | CAGUCUCUCAGGAUUCUGGAG |
| 4147 | 1939 | CAUAGUGCUUCGUUUACUUUG |
| 4148 | 1940 | ACACUAUAUAGUUUGCUGAAA |
| 4149 | 1941 | UUUCAGGUAUUAAGGAGAUUA |
| 4150 | 1942 | AAUGAGAUACAAUUCUGAUAA |
| 4151 | 1943 | GUGACUUCUCUAGGUAUAGGG |
| 4152 | 1944 | CUGGUCUCGAACUCCUGACCU |
| 4153 | 1945 | AGUUCUGUUUAGAUUCUUUUA |
| 4154 | 1946 | UGCACAUGGAGGUGAUAUCUC |
| 4155 | 1947 | UGCUUCUUAGCUUCUCUAAGA |
| 4156 | 1948 | UUCAGGUAUUAAGGAGAUUAA |
| 4157 | 1949 | UCUCCCUAGCUUUAACUUAUA |
| 4158 | 1950 | AUUCUACAUUUAUCUGGUUUU |
| 4159 | 1951 | GUCCACAUGCAAAUACACGUU |
| 4160 | 1952 | AACAUUCUCAAUGCUAAUAG |
| 4161 | 1953 | AUCCACAUCCAUCUCAAGACA |
| 4162 | 1954 | UGAUUCCUCUUGGGUACUAA |
| 4163 | 1955 | AUAAUCCCAGUAGACAUCACU |
| 4164 | 1956 | AUAUGUUUCAUAAGCACAAGA |
| 4165 | 1957 | AGUGUUUAGGUUCACUCUUAG |
| 4166 | 1958 | UAUUAAACACAUUCCCAAUGC |
| 4167 | 1959 | GAUUAUGACAACGCACUGGAU |
| 4168 | 1960 | UCUGGACAUCUAAUGACAAUG |
| 4169 | 1961 | CUAUAACACAAAUUGUUAGUU |

TABLE 6-continued

Results for PAK3.
Score threshold: 70. Design: siRNA 21 nt.

| SEQ ID NO | siRNA_id | siRNA guide strand/ AS Sequence |
|---|---|---|
| 4170 | 1962 | UGGAGCUCUGGAGUUCCAUUA |
| 4171 | 1963 | UGAACUCACCUAGCAGGAUGU |
| 4172 | 1964 | AUGGACUUCCACAUGUUCACA |
| 4173 | 1965 | UGCCUACAGUGAUCUGAAGGG |
| 4174 | 1966 | UGUACAUAAGUUCUGUUUAGA |
| 4175 | 1967 | AAAUAUUUACAAUGACACACA |
| 4176 | 1968 | AGCAAUAUUAUAACAAUAUCA |
| 4177 | 1969 | CACUACAUCUGACUCAUUCUC |
| 4178 | 1970 | UUCAAAGUGAAUGCACAAAAU |
| 4179 | 1971 | UCUAUUGAAAUUAGUGGGACU |
| 4180 | 1972 | ACAUCUCCCUAGCUUUAACUU |
| 4181 | 1973 | AUUAAUUUAGGUAUCAUUAUC |
| 4182 | 1974 | CUCUCUCUCUCAUUAGAGCAG |
| 4183 | 1975 | UCAGUUCCCGCAUUUGCAGAU |
| 4184 | 1976 | UGCAAUGUCUAGUGCUGUAUA |
| 4185 | 1977 | CUUUGAGCUGAGAAAUAUCAU |
| 4186 | 1978 | AAUAAAUAAUCUCUACUGUGC |
| 4187 | 1979 | AGUAGCUGGGAUUACAGGCGC |
| 4188 | 1980 | AAUGUCCAACAAGGAUUUCAG |
| 4189 | 1981 | AUUUCUUUGGUGAGUUAGAAG |
| 4190 | 1982 | UCUUUAUAUCUCUAUGGAUCA |
| 4191 | 1983 | UAUUUGCAAUACUUUAGGUCC |
| 4192 | 1984 | AGAUACAAUGCCCUGAGUGGA |
| 4193 | 1985 | AUUUGCGGUCCAUAAAGCAC |
| 4194 | 1986 | CAAAUAAAUUACAUAAUCUGA |
| 4195 | 1987 | UUGCAAGGCAACCUAUAAUGC |
| 4196 | 1988 | CUGUGAAGAUCUUAUCAUCAA |
| 4197 | 1989 | UCCCUUUCUGCUGUUUAUUUA |
| 4198 | 1990 | AGAGACUGGGAGAUACUUGCA |
| 4199 | 1991 | UGGGCUGCUAUGUAUCCAUGU |
| 4200 | 1992 | UCAUGUAUUUCUGGUUGUUGA |
| 4201 | 1993 | AAGUGACUUGCCUAGCGUCAC |
| 4202 | 1994 | GAAAGCAUAAGAGAGAAGCCA |
| 4203 | 1995 | GAAAUUAGUGGGACUUGCCCU |
| 4204 | 1996 | GAGAGGUUAAGUGACUUGCCU |
| 4205 | 1997 | CUAAUAGCAUGUAAUUACUUU |
| 4206 | 1998 | UCUUGGGAUAUGAUUGUAAGU |
| 4207 | 1999 | UGUCUAUAGUUCCCUUUCUGC |
| 4208 | 2000 | UCAAACUGUCAGUUUACAAAU |
| 4209 | 2001 | AUAAUUCCAAGAGACCAGAUA |
| 4210 | 2002 | AGGUUCACUCUUAGCAGUCUC |
| 4211 | 2003 | CUACCCAUAGUUCAUCACCCA |
| 4212 | 2004 | CUUGGGUUGCUGUUGAAGGUU |
| 4213 | 2005 | GACCAGAUAUCAACUUUCGGA |
| 4214 | 2006 | AAUAAUCUCUACUGUGCUUCU |
| 4215 | 2007 | GUUACAACUAAUUUCACAGCU |
| 4216 | 2008 | GUCACUUCAACAUUGCUGCCC |
| 4217 | 2009 | CUCAUUCUCUACUAUCGCUGU |
| 4218 | 2010 | AGUGACAUCUCCCUAGCUUUA |
| 4219 | 2011 | UUUGGUGAGUUAGAAGGAAGU |
| 4220 | 2012 | CUUUAUUUAGAUAUACAGUUU |
| 4221 | 2013 | UACUGUGCUUCUCACCCUUCC |
| 4222 | 2014 | UAAGGAUCAUCUAGUCCAAUA |
| 4223 | 2015 | CAUUCUCUACUAUCGCUGUUG |
| 4224 | 2016 | UGCAGACAGCUGCUAUCUGUC |
| 4225 | 2017 | CAUCACUACCCUGUGAUCUGG |
| 4226 | 2018 | CUCUUUAUUUGGUACUGCUGG |
| 4227 | 2019 | ACAUUCCCAAUGCAUGUUGGG |
| 4228 | 2020 | UGCUGGGAUUACAGGUAUGAG |
| 4229 | 2021 | ACAUGGUUUACAGAUAACACA |
| 4230 | 2022 | UUAAUAUGCUGAACUGAAAGC |
| 4231 | 2023 | GUACUAAAUCUGUUGAACAUG |
| 4232 | 2024 | AAGGAAUUCUGUCGGACUGAC |
| 4233 | 2025 | ACAGCUGCUAUCUGUCCUUCA |
| 4234 | 2026 | GUCAUCAGAAAUGCUAUCUUU |
| 4235 | 2027 | CUGGUUUACUCAAUUAUCUUU |
| 4236 | 2028 | AAAUUAAUUUGUCAACAUUUC |
| 4237 | 2029 | ACAUAGUAUGCUUCAAAUUAA |
| 4238 | 2030 | CAUUGUUAAUAUGCUGAACUG |
| 4239 | 2031 | AUGGAGGCUCAGAUGCUGUUU |
| 4240 | 2032 | CAAAGUGGUAGUAAAGAAGUA |
| 4241 | 2033 | UUUCCUCCUGGUAUGCCUAUU |
| 4242 | 2034 | AACUCUAGAAAGCCCAGCACU |
| 4243 | 2035 | UCACCACAACCUCCGCCUCCU |

TABLE 6-continued

Results for PAK3.
Score threshold: 70. Design: siRNA 21 nt.

| SEQ ID NO | siRNA_id | siRNA guide strand/ AS Sequence |
|---|---|---|
| 4244 | 2036 | AUUUAACUGCAACAUAAGAGA |
| 4245 | 2037 | UUAUUUCCUUCCCAGUCCACA |
| 4246 | 2038 | GUGAUCUGAAGGGUCACUGCU |
| 4247 | 2039 | UCACUAUAGCAGGCUGAAUUU |
| 4248 | 2040 | AUGUAUUUCUGGUUGUUGACU |
| 4249 | 2041 | AAUACUUUAGGUCCAAGUUUC |
| 4250 | 2042 | CUAAGCAUGAACACACCAUAU |
| 4251 | 2043 | AUGGAUCACCUGGUUUGAGUG |
| 4252 | 2044 | UUUGUUUAAUGAUUUCAAAGU |
| 4253 | 2045 | AUCUCUACUGUGCUUCUCACC |
| 4254 | 2046 | AAGAUCUCCUCAUCUGUCAUC |
| 4255 | 2047 | CAAACAACCUAUAAAUAGGCA |
| 4256 | 2048 | AUUAUGACAACGCACUGGAUC |
| 4257 | 2049 | ACAUGUAAGGGAUGCUAACUA |
| 4258 | 2050 | GAAAUAUUCCAUUAUUUCCAA |
| 4259 | 2051 | AUUCUUUCAUAGGAGAAAUAU |
| 4260 | 2052 | CCAGUCUUUGUCCAUAUGCAU |
| 4261 | 2053 | UCUGACUCAUUCUCUACUAUC |
| 4262 | 2054 | AACAUCAAAGAUUUGGAUAGA |
| 4263 | 2055 | CACAAUGCUUCUUAGCUUCUC |
| 4264 | 2056 | CAGAUAUCAACUUUCGGACCA |
| 4265 | 2057 | AUAUCUGCAACAGAUGUUAUC |
| 4266 | 2058 | AGGCCUAUGUAACUGAUCUCU |
| 4267 | 2059 | UCCUUUGGUUAGAUGGUCUCC |
| 4268 | 2060 | AAUCCCAGGCCCAUCAAACUG |
| 4269 | 2061 | UCCAAAGUUACAGAAGAAUUU |
| 4270 | 2062 | AGAGAAUAAACUGUUAACAAU |
| 4271 | 2063 | UAGUUCCCUUUCUGCUGUUUA |
| 4272 | 2064 | AUGAUCUCAGCUCACCACAAC |
| 4273 | 2065 | UGAGAAAUAUCAUUUAUAGAC |
| 4274 | 2066 | ACUUUAUGGUCACUUCAACAU |
| 4275 | 2067 | AUGUAUCCAUGUGCACUUUUA |
| 4276 | 2068 | AUUGCUUCCUUUGCAGCGAUA |
| 4277 | 2069 | AGUAUUUCUGUAUUGAAAUG |
| 4278 | 2070 | CAUAAAGCACACCACACACAA |
| 4279 | 2071 | UGGUCACUUCAACAUUGCUGC |
| 4280 | 2072 | CUUGUGGGUUCUUCUUCUGUU |
| 4281 | 2073 | AUCUCCCUAGCUUUAACUUAU |
| 4282 | 2074 | UUGCCGAGGCUGGAGUGCAAU |
| 4283 | 2075 | AGUAUAACAUAGUAUGCUUCA |
| 4284 | 2076 | AGGGACUACUCUCUAACUUAA |
| 4285 | 2077 | AGAACGAGUAUAGAUUGAUUU |
| 4286 | 2078 | AAUAUAAUUAUUUACACGAUC |
| 4287 | 2079 | UUGGUUCCCAACAAAUUAAUU |
| 4288 | 2080 | AAGGCCUCUCUCUCUCAUUAG |
| 4289 | 2081 | GAUAGAUGUAAGGAUCAGGUG |
| 4290 | 2082 | AUCCAUCUCAAGACAGCGAUU |
| 4291 | 2083 | AUCUGAAUAACAUAAAGAAUA |
| 4292 | 2084 | UGUUUAAUAUUAAACACAUUC |
| 4293 | 2085 | CUUCUAUAACACAAAUUGUUA |
| 4294 | 2086 | AAUAACAUAAAGAAUAAAUAC |
| 4295 | 2087 | CAAUGCAUUAGUAGCUACAGG |
| 4296 | 2088 | AAGCCUGAAAGAAAUCUGAAU |
| 4297 | 2089 | UGAAGGGUCACUGCUCCAAGG |
| 4298 | 2090 | UAUAGACAAAUAUCUCAAACU |
| 4299 | 2091 | GUUGAGUGCUGAAGAAUCCCG |
| 4300 | 2092 | ACCAAGAGAUUCAACCGGGGA |
| 4301 | 2093 | CUUUAUAUCUCUAUGGAUCAC |
| 4302 | 2094 | AUAAAUACCUUUAAUCCAAAG |
| 4303 | 2095 | AAAGUGGUAGUAAAGAAGUAC |
| 4304 | 2096 | AAGGAAUAUAAUUAUUUACAC |
| 4305 | 2097 | AGGCUUACAAAUAAAUUACAU |
| 4306 | 2098 | UCUCAACAUGUAAGGGAUGCU |
| 4307 | 2099 | GAUUAAUGUAUCUAUUUCCUC |
| 4308 | 2100 | ACCUGAACUCACCUAGCAGGA |
| 4309 | 2101 | AGUAAAUGCUACAAGUUGUAU |
| 4310 | 2102 | AGUUGUAUAGAAUACUCGUAC |
| 4311 | 2103 | UCAUAAGCACAAGAGAGGAUU |
| 4312 | 2104 | UGCUAUGUAUCCAUGUGCACU |
| 4313 | 2105 | CAGAAGAAUUUCACUACACAU |
| 4314 | 2106 | AUAUCUCUGCCCUGCAUGCUC |
| 4315 | 2107 | ACCUUUAAUCCAAAGUUACAG |
| 4316 | 2108 | AUCCUCAUGGGAUUAUGACAA |
| 4317 | 2109 | AAUUUGUAUCAUAAGUAAAUG |

TABLE 6-continued

Results for PAK3.
Score threshold: 70. Design: siRNA 21 nt.

| SEQ ID NO | siRNA_id | siRNA guide strand/ AS Sequence |
|---|---|---|
| 4318 | 2110 | AGUCACUAAUGUACUGAUUUU |
| 4319 | 2111 | UCAAAUUAAUAUUACCGUUUC |
| 4320 | 2112 | GAUUUGGAUAGACUCACCUGU |
| 4321 | 2113 | UUGUUGCCGAGGCUGGAGUGC |
| 4322 | 2114 | CUACACAGACACUCCGCAGAU |
| 4323 | 2115 | AAAUCCAAAGCUUGCAGGCAC |
| 4324 | 2116 | AUAUCUCAGUUCCCGCAUUUG |
| 4325 | 2117 | AGUCUUUGUCCAUAUGCAUUU |
| 4326 | 2118 | AUUAAUUCCUUCUUGGGUUGC |
| 4327 | 2119 | UGUGGAUAUAUGGAUGGUUAG |
| 4328 | 2120 | UUGUUUAAAUGUGGUUUCUCC |
| 4329 | 2121 | AGACACUCCGCAGAUAUUUUU |
| 4330 | 2122 | UGUGAAUCCUUCAGCAUCACU |
| 4331 | 2123 | CAUCUAGUCCAAUACACUUAU |
| 4332 | 2124 | CUCGAUUGUACCAAAUGUGAA |
| 4333 | 2125 | AUCUUUGUUUACUUAAUGUCC |
| 4334 | 2126 | UAACCCUGUUUAUGUUAUUU |
| 4335 | 2127 | AUUACCCAACAUGGUGACUGA |
| 4336 | 2128 | CAUAAUCUGAGGGAGUAGGAA |
| 4337 | 2129 | AUAAACCCAUUGAGCAAAGGA |
| 4338 | 2130 | AGAUGUGGAUAUAUGGAUGGU |
| 4339 | 2131 | AGCUUAGAUAAAGACCAAGAG |
| 4340 | 2132 | UGGAGAGAAUUUCAAGACAUU |
| 4341 | 2133 | ACACAUUCCCAAUGCAUGUUG |
| 4342 | 2134 | CAAGUUCCCAUUUAUUUCCUU |
| 4343 | 2135 | CAACACUCACAAUGCUUCUUA |
| 4344 | 2136 | AUGAAUACAAAUUUAUAAAAG |
| 4345 | 2137 | UGAAUAUUAACUGCAAGUAGC |
| 4346 | 2138 | AGAGGGUGGUGUGACCUCUUU |
| 4347 | 2139 | UGCAGCGAUAAUCAGAGGAGU |
| 4348 | 2140 | AUAUUCAUUUGGUCACUUAAA |
| 4349 | 2141 | UGCAAGUUCAACCCAAUUAAG |
| 4350 | 2142 | GAAUCAACAUUGAAAGAUGUG |
| 4351 | 2143 | UAAAUAGAUAUAUGGUGAAAU |
| 4352 | 2144 | AGAUGUUAUGAGUAUAAUCCC |
| 4353 | 2145 | GUAGCUUAGAUAAAGACCAAG |
| 4354 | 2146 | AGUCAGGCUGGAGAGAGGCUU |
| 4355 | 2147 | AUCUUAUCAUCAAUAAUGAAU |
| 4356 | 2148 | CAACAUGGUGACUGAUUUGAG |
| 4357 | 2149 | UGGGAAGUGGUUUGGAGCUGU |
| 4358 | 2150 | AAGAUCUUAUCAUCAAUAAUG |
| 4359 | 2151 | CAUUGCUCUGGAAUUCCAGUG |
| 4360 | 2152 | AGAAAUCUGAAUAACAUAAAG |
| 4361 | 2153 | ACAUUAACGUUCUUUCCUUUU |
| 4362 | 2154 | AGGGAAAGAGAAUAAACUGUU |
| 4363 | 2155 | CAGGAUUCUGGAGCUCUGGAG |
| 4364 | 2156 | CAAAUGCUGAAUUUCAGUCCU |
| 4365 | 2157 | CAACACUAUGAAGAGGGAGUG |
| 4366 | 2158 | AGGGCACACUAGCAACAUCAA |
| 4367 | 2159 | GAAGUCAUUACCCAACAUGGU |
| 4368 | 2160 | CAACUUUCUGUAAUUUACAAA |
| 4369 | 2161 | CAUCUCCCUAGCUUUAACUUA |
| 4370 | 2162 | GAAAUAGGUGAUACAUAGGAA |
| 4371 | 2163 | AACAACCAUAAAAUAGGCAGA |
| 4372 | 2164 | UGUGACCACAUCAGUCAGAGA |
| 4373 | 2165 | UACAAUGCCCUGAGUGGAUUU |
| 4374 | 2166 | AGUCCACAUGCAAAUACACGU |
| 4375 | 2167 | AGUCUUACUCAUGAGGGAGAU |
| 4376 | 2168 | UAGCUUAGAUAAAGACCAAGA |
| 4377 | 2169 | AUUUGCAAGGCAACCUAUAAU |
| 4378 | 2170 | AUUUGUCAACAUUCUCAAUG |
| 4379 | 2171 | GUAUGCUCUGGUCUUGGUGCG |
| 4380 | 2172 | CACUAUAGCAGGCUGAAUUUG |
| 4381 | 2173 | CAGAUUCAGUUAGACAUUGUU |
| 4382 | 2174 | UAUGGAUGGUUAGAUGGAUGG |
| 4383 | 2175 | CUUAGCUUCUCUAAGAUCUCC |
| 4384 | 2176 | UCCUCCUGGGAAGAUAGAGCG |
| 4385 | 2177 | AGGUCAGAAGGAUGGAACCAU |
| 4386 | 2178 | CAACAGAUGUUAUCAAGGGGG |
| 4387 | 2179 | CAACUACUGCAAACAACCUAU |
| 4388 | 2180 | UCACCUUCCACCAUUUCAAUU |
| 4389 | 2181 | AAUGGAGGCUCAGAUGCUGUU |
| 4390 | 2182 | CUAGUAUUAUCCCACUACAUU |
| 4391 | 2183 | CAUGUUCACACAGUACUUGCU |

TABLE 6-continued

Results for PAK3.
Score threshold: 70. Design: siRNA 21 nt.

| SEQ ID NO | siRNA_id | siRNA guide strand/ AS Sequence |
|---|---|---|
| 4392 | 2184 | GUACACACAGGUGUGCACAUG |
| 4393 | 2185 | ACACGAGAUCAGCAAGAACGA |
| 4394 | 2186 | ACUUCAACAUUGCUGCCCUGU |
| 4395 | 2187 | GUUCCCACCAUAGUGCUUCGU |
| 4396 | 2188 | AAUUCUGAUAAACAAUGAAAA |
| 4397 | 2189 | AACAGGCAGAGACAGUCCUAC |
| 4398 | 2190 | CUGUGCUUCUCACCCUUCCCU |
| 4399 | 2191 | AAUUACAUAAUCUGAGGGAGU |
| 4400 | 2192 | AGCGAUAAUCAGAGGGAGUCAG |
| 4401 | 2193 | UGAUUGGGAUGUAGCCUUCAC |
| 4402 | 2194 | UGGGACUUGCCCUAUUGGUUA |
| 4403 | 2195 | UGGAUCACCUGGUUUGAGUGC |
| 4404 | 2196 | UUGGUCAGGCUGGUCUCGAAC |
| 4405 | 2197 | UCCUACAUAUUUGUUUAAUGA |
| 4406 | 2198 | ACCACAUCAGUCAGAGAGCCA |
| 4407 | 2199 | AGAGAAACAACUUUCUGUAAU |
| 4408 | 2200 | UCCUUCUUGGGUUGCUGUUGA |
| 4409 | 2201 | UACAGACAACAGGAAGCAAUU |
| 4410 | 2202 | UGGAAUCAACAUUGAAAGAUG |
| 4411 | 2203 | AUAAUCUGAGGGAGUAGGAAA |
| 4412 | 2204 | AGUGGUUUGGAGCUGUGGGUUG |
| 4413 | 2205 | UGCCUAGCGUCACAUAGCAAU |
| 4414 | 2206 | AUCCCGAGAAGAAUAUUGUCA |
| 4415 | 2207 | UAUUAAAGUUCUCACCUAAAA |
| 4416 | 2208 | AAAGCAAUAUUAUAACAAUAU |
| 4417 | 2209 | AUCCCAAUGCAUGUUGGGUU |
| 4418 | 2210 | CUAGCUUUAACUUAUAGAUAA |
| 4419 | 2211 | CAUCCAUACAGGUCUCUGUGA |
| 4420 | 2212 | UGUACUCGAAGGAUGGGCUGC |
| 4421 | 2213 | UCCAAAGCUUGCAGGCACUCU |
| 4422 | 2214 | AGGUGGUUAAACUCAAACAUU |
| 4423 | 2215 | AUUUGUUUAAUGAUUUCAAAG |
| 4424 | 2216 | UUGGUACAAAGUGGUAGUAAA |
| 4425 | 2217 | UAUGAAGAGGGAGUGUGCAUC |
| 4426 | 2218 | CAAAUAUUUACAAUGACACAC |
| 4427 | 2219 | CUGAAGGAAGAGAGAUCUCUG |
| 4428 | 2220 | UGCUCUGGAAUUCCAGUGAAU |
| 4429 | 2221 | AGAGAGGCCUAUGUAACUGAU |
| 4430 | 2222 | GAAUACAGCUGACAGUCUCUC |
| 4431 | 2223 | AAGUUUCAAACUGCAAUAUUU |
| 4432 | 2224 | CUGACCUCAGGUGAUCCGCCU |
| 4433 | 2225 | ACUGGGAACAGUCAACAGAAA |
| 4434 | 2226 | GUUAUGAGUAUAAUCCCAGUA |
| 4435 | 2227 | UUGUUUACUUAAUGUCCAACA |
| 4436 | 2228 | CUAUAUAGUUUGCUGAAACUC |
| 4437 | 2229 | AUUCAUUUGGUCACUUAAAGG |
| 4438 | 2230 | CUUAAACGUGAUAUUUGCCAU |
| 4439 | 2231 | CACCACAACCUCCGCCUCCUG |
| 4440 | 2232 | AAUGUGGUUUCUCCUAUGAGG |
| 4441 | 2233 | UGAGGGAGAUGGUGAGGUGUA |
| 4442 | 2234 | UGGGUUAUAUUCAUUUGGUCA |
| 4443 | 2235 | AACGCACUGGAUCCUUGCUAA |
| 4444 | 2236 | UUACUUUGCUCAGGAGUGAUC |
| 4445 | 2237 | CUCUGCAACUUGUAAGUGUUU |
| 4446 | 2238 | CUCUAAGAUCUCCUCAUCUGU |
| 4447 | 2239 | AGGAUGUCACAGUUUCAGUUU |
| 4448 | 2240 | UCUCUACUGUGCUUCUCACCC |
| 4449 | 2241 | AGAAUUUCAAGACAUUUAUGA |
| 4450 | 2242 | UCACUGUGGGAGUUGUCAUCA |
| 4451 | 2243 | AAUACUUAUUAGAAAUAUACA |
| 4452 | 2244 | AGUCCUCUUGUUCAGAGCUCA |
| 4453 | 2245 | CAAACACAACACUAUGAAGAG |
| 4454 | 2246 | CAGCUUCUAAAGGAGACUCCG |
| 4455 | 2247 | UGGGACCAUCCACUAACUCCC |
| 4456 | 2248 | AUCAAAGAUUUGGAUAGACUC |
| 4457 | 2249 | UGGGAUUACAGGCGCCCGCCA |
| 4458 | 2250 | CUAACCAACAGAAAGAUUAUA |
| 4459 | 2251 | AAGUAGCUAUCUAAAUAAUUA |
| 4460 | 2252 | CUUUAUGGUCACUUCAACAUU |
| 4461 | 2253 | AGGUAUUAAGGAGAUUAACAA |
| 4462 | 2254 | AAAUUAAGAAGCCUUCUAUAA |
| 4463 | 2255 | ACAGUCAUGCACAAUCCAUAU |
| 4464 | 2256 | UCAGGGCACACUAGCAACAUC |
| 4465 | 2257 | AGACUCAGGCUUAAACGUGAU |

TABLE 6-continued

Results for PAK3.
Score threshold: 70. Design: siRNA 21 nt.

| SEQ ID NO | siRNA_id | siRNA guide strand/ AS Sequence |
|---|---|---|
| 4466 | 2258 | GGACCAUCCACUAACUCCCAG |
| 4467 | 2259 | CUGAAUAACAUAAAGAAUAAA |
| 4468 | 2260 | UGGGUUGCUGUUGAAGGUUCA |
| 4469 | 2261 | UGCUACAAGUUGUAUAGAAUA |
| 4470 | 2262 | CUAUAGUUCCCUUUCUGCUGU |
| 4471 | 2263 | GUGUGCAUCUUUGAGAAACCU |
| 4472 | 2264 | CUAGGUAUAGGGUCUGCUUUU |
| 4473 | 2265 | UCUAUUUCCUCCUGGUAUGCC |
| 4474 | 2266 | AAUAUACAUAACUCUCCAAUA |
| 4475 | 2267 | GUAAAGCUCAUGUAUUUCUGG |
| 4476 | 2268 | UUCCCUUUCUGCUGUUUAUUU |
| 4477 | 2269 | CACAUGCAAAUACACGUUCAG |
| 4478 | 2270 | UCGAGUCACCACCUCAGGUGC |
| 4479 | 2271 | GAGGUGAUAUCUCAGUUCCCG |
| 4480 | 2272 | GUCUUGGUGCGAUAACUGGUG |
| 4481 | 2273 | GUUUACUAUAUCACCUUUCUC |
| 4482 | 2274 | CUCUCUGCAACUUGUAAGUGU |
| 4483 | 2275 | ACUUUCGGACCAUAAGCUUUU |
| 4484 | 2276 | AAUAUUGAUUGGGAUGUAGCC |
| 4485 | 2277 | GUUUGAGUGCAGGAAAUCCAA |
| 4486 | 2278 | CAGAAUUUCAUUAUAAUUAA |
| 4487 | 2279 | AGUACUUGCUCUGGUAUUUUU |
| 4488 | 2280 | UUUCCAAGUUCCCAUUUAUUU |
| 4489 | 2281 | AAACAGCUUCUUUCUAAUACU |
| 4490 | 2282 | UGCUAACAACAUUAACGUUCU |
| 4491 | 2283 | AGGUCCAAGUUUCAAACUGCA |
| 4492 | 2284 | UUCAGUCCUCUUGUUCAGAGC |
| 4493 | 2285 | UUCUCAACAUGUAAGGGAUGC |
| 4494 | 2286 | GAAGGAAGAGAGAUCUCUGGG |
| 4495 | 2287 | UGUAGAUGUUAUGAGUAUAAU |
| 4496 | 2288 | AGGCACUCUCUGCAGACAGCU |
| 4497 | 2289 | ACAUCUGACUCAUUCUCUACU |
| 4498 | 2290 | CCUCUUUAUUUGGUACUGCUG |
| 4499 | 2291 | UCAAGCCUCUCCCAACUUUUA |
| 4500 | 2292 | UCAUGAGGGAGAUGGUGAGGU |
| 4501 | 2293 | ACAUUGAAAGAUGUGCCCUCG |
| 4502 | 2294 | UCUGCCCUGCAUGCUCUGCGC |
| 4503 | 2295 | CUCUGGGCGCUCUUUCUCCUU |
| 4504 | 2296 | CACCACCCUAACACAACUGAU |
| 4505 | 2297 | ACAUAAUCUGAGGGAGUAGGA |
| 4506 | 2298 | CAAUAUCUGCAACAGAUGUUA |
| 4507 | 2299 | UCAAUGCUAAUAGCAUGUAAU |
| 4508 | 2300 | CAUGGUUUACAGAUAACACAU |
| 4509 | 2301 | UGUAAGUGUUUAGGUUCACUC |
| 4510 | 2302 | AUAUUAUAACAAUAUCAAAUA |
| 4511 | 2303 | UCUAUUCAUUUGAAAGGUAAA |
| 4512 | 2304 | AUGGGCUGCUAUGUAUCCAUG |
| 4513 | 2305 | GAUAUAUUAUUAUCAAAUCUU |
| 4514 | 2306 | CUCAGGAUUCUGGAGCUCUGG |
| 4515 | 2307 | AUGUAAGGGAUGCUAACUAAU |
| 4516 | 2308 | AAACUGUCAGUUUACAAAUGC |
| 4517 | 2309 | GAAUUCUGUCGGACUGACAUU |
| 4518 | 2310 | AUAGUGCUUCGUUUACUUUGC |
| 4519 | 2311 | AUCUCAGUUCCCGCAUUUGCA |
| 4520 | 2312 | UAUUGAGAAUGACCAAUAAAA |
| 4521 | 2313 | UGGUCACUAAAGGAGUGUGG |
| 4522 | 2314 | GAGUGCUGAAGAAUCCCGGUU |
| 4523 | 2315 | UACCUUUAAUCCAAAGUUACA |
| 4524 | 2316 | ACAUCUAAUGACAAUGCAAGU |
| 4525 | 2317 | CCACACACAAGCACACACAUU |
| 4526 | 2318 | CAGGUGGUUAAACUCAAACAU |
| 4527 | 2319 | UCCACAUGUUCACACAGUACU |
| 4528 | 2320 | UUAUAACAAUAUCAAAUAAAA |
| 4529 | 2321 | UCUUGCAAGUUCAACCCAAUU |
| 4530 | 2322 | CAGUAAAUGCUACAAGUUGUA |
| 4531 | 2323 | UGCAUAUGUUUCAUAAGCACA |
| 4532 | 2324 | CAGCUCACCACAACCUCCGCC |
| 4533 | 2325 | ACUUCCACAUGUUCACACAGU |
| 4534 | 2326 | GUUUACUUAAUGUCCAACAAG |
| 4535 | 2327 | UAAAUACCUUUAAUCCAAAGU |
| 4536 | 2328 | CUAGCAACAUCAAAGAUUUGG |
| 4537 | 2329 | ACUCUAGAAAGCCCAGCACUA |
| 4538 | 2330 | AUACCUUUAAUCCAAAGUUAC |
| 4539 | 2331 | AGAAAGUCCCAUCUUUGUUUA |

TABLE 6-continued

Results for PAK3.
Score threshold: 70. Design: siRNA 21 nt.

| SEQ ID NO | siRNA_id | siRNA guide strand/ AS Sequence |
|---|---|---|
| 4540 | 2332 | CAAGGCAACCUAUAAUGCCAU |
| 4541 | 2333 | CCUCAUUAGAAAUAAACCCAU |
| 4542 | 2334 | AGGAAAUCCAAAGCUUGCAGG |
| 4543 | 2335 | UCUUCAUUAUCCAGACCGUCA |
| 4544 | 2336 | ACAUAAACACGUACACUAUAU |
| 4545 | 2337 | GUGUUUGGAGUUCUAAUAGUG |
| 4546 | 2338 | ACAGACACUCCGCAGAUAUUU |
| 4547 | 2339 | CUAAAUAAUUAACAAUAUUAG |
| 4548 | 2340 | CUGUUGAUUCCUCUUGGGUA |
| 4549 | 2341 | AGCUCUGGAGUUCCAUUAGUG |
| 4550 | 2342 | GUGAUAUUAUAGAAUCUCUCA |
| 4551 | 2343 | ACCUAGCAGGAUGUCACAGUU |
| 4552 | 2344 | UUUCACCGUUUGAGCUUUAUU |
| 4553 | 2345 | UGUCACAGUUUCAGUUUCAGU |
| 4554 | 2346 | CCUUGCUAACAACAUUAACGU |
| 4555 | 2347 | AGCUUUAUUUAGAUAUACAGU |
| 4556 | 2348 | UAUUUGCAUCCCAGGAUUUCA |
| 4557 | 2349 | AUUGAAAUUAGUGGGACUUGC |
| 4558 | 2350 | UGUAUGCUCUGGUCUUGGUGC |
| 4559 | 2351 | UCACCCUUCCCUGACUUUCCC |
| 4560 | 2352 | GUGAUAUCUCAGUUCCCGCAU |
| 4561 | 2353 | CAACAGGAAGCAAUUUCGUGU |
| 4562 | 2354 | CUACCGAAUGAUAUACAGUA |
| 4563 | 2355 | CUCUUCAUCUUCUUCUUCAGA |
| 4564 | 2356 | CACUGUGGGAGUUGUCAUCAG |
| 4565 | 2357 | AAGGAUGGAACCAUACCAUCA |
| 4566 | 2358 | UGUUCCAGUCUUUGUCCAUA |
| 4567 | 2359 | AUUACAGGCCCAGAUUCGUUU |
| 4568 | 2360 | GUUUGGAGUAAUCGUGCCCAU |
| 4569 | 2361 | UGAAAGAUGUGCCCUCGUUAU |
| 4570 | 2362 | AAUGUGAAUCCUUCAGCAUCA |
| 4571 | 2363 | CUCUAGGUAUAGGGUCUGCUU |
| 4572 | 2364 | GUUUCUAUUCAUUUGAAAGGU |
| 4573 | 2365 | ACUCAUGAGGGAGAUGGUGAG |
| 4574 | 2366 | CUCAGCUCACCACAACCUCCG |
| 4575 | 2367 | ACACCAUAUUCCGAAACAGAA |
| 4576 | 2368 | AAUUUCAUUAAUAAUUAAUUC |
| 4577 | 2369 | ACACCACACACAAGCACACAC |
| 4578 | 2370 | AGAGGGAGUGUGCAUCUUUGA |
| 4579 | 2371 | AAACGUUAUAAAUUGUCAAAA |
| 4580 | 2372 | AGUCAUGCACAAUCCAUAUUU |
| 4581 | 2373 | GUAUUUCUGGUUGUUGACUGU |
| 4582 | 2374 | UAUCUCAGUUCCCGCAUUUGC |
| 4583 | 2375 | AGUGCUGAAGAAUCCCGGUUG |
| 4584 | 2376 | GAGUUGUCAUCAGAAAUGCUA |
| 4585 | 2377 | CACUACUUCACAGGAAAGGAG |
| 4586 | 2378 | CUCUAUGUUGGUCAGGCUGGU |
| 4587 | 2379 | UCGAAGGAUGGGCUGCUAUGU |
| 4588 | 2380 | AGAAUUAAACUCUAGAAAGCC |
| 4589 | 2381 | AUCACUGUGGGAGUUGUCAUC |
| 4590 | 2382 | CUAUAUCACCUUUCUCUAGAU |
| 4591 | 2383 | AAAUGUGAAUCCUUCAGCAUC |
| 4592 | 2384 | ACACACAAAUAUUUACAAUGA |
| 4593 | 2385 | ACUCGAUUGUACCAAAUGUGA |
| 4594 | 2386 | AAGAAUCCUACCUGAAUGAUA |
| 4595 | 2387 | CAUAAAGAAUAAAUACUUGAG |
| 4596 | 2388 | AUCAGAUACAAUGCCCUGAGU |
| 4597 | 2389 | ACAUCACUACCCGUGAUCUG |
| 4598 | 2390 | UGCAAACAACCUAUAAAUAGG |
| 4599 | 2391 | CAUAGUUGUAAUCCCUGUUUA |
| 4600 | 2392 | ACAGUCCUACAUAUUUGUUUA |
| 4601 | 2393 | GGGAUUAUGACAACGCACUGG |
| 4602 | 2394 | UCCUUGCUAACAACAUUAACG |
| 4603 | 2395 | ACGAAGUCAUUACCCAACAUG |
| 4604 | 2396 | UACUCAUGAGGGAGAUGGUGA |
| 4605 | 2397 | AGAACUAAGCAUGAACACACC |
| 4606 | 2398 | AAUCAACAUUGAAAGAUGUGC |
| 4607 | 2399 | UCUUUGUUUAAAUGUGGUUUC |
| 4608 | 2400 | CUUUGGUUAGAUGGUCUCCCU |
| 4609 | 2401 | AGAUCAGCAAGAACGAAGUCA |
| 4610 | 2402 | GUUUGCUGAAACUCUAAAGAA |
| 4611 | 2403 | AGAAGCCUUCUAUAACACAAA |
| 4612 | 2404 | CUUUGCUUAACUGAAUAUUAA |
| 4613 | 2405 | AUAUCAACUUUCGGACCAUAA |

TABLE 6-continued

Results for PAK3.
Score threshold: 70. Design: siRNA 21 nt.

| SEQ ID NO | siRNA_id | siRNA guide strand/ AS Sequence |
|---|---|---|
| 4614 | 2406 | ACACACAUAUUCCUCUCCACU |
| 4615 | 2407 | AUAACAUAGUAUGCUUCAAAU |
| 4616 | 2408 | CAAGACACAGUCAUGCACAAU |
| 4617 | 2409 | CAGAUAACACAUUCUGACAAA |
| 4618 | 2410 | GUUUAAAUGUGGUUUCUCCUA |
| 4619 | 2411 | AAGCAGCAUAUCUGAGGUGAC |
| 4620 | 2412 | UGGAGUAAUCGUGCCCAUUGC |
| 4621 | 2413 | ACGGUGGAAGUGACCACUUUA |
| 4622 | 2414 | ACCACAACCUCCGCCUCCUGG |
| 4623 | 2415 | AGCAAUGGAUUCAACCACAGA |
| 4624 | 2416 | AUUAGUGGGACUUGCCCUAUU |
| 4625 | 2417 | AGUUUACCCUCUUUCCAGCAG |
| 4626 | 2418 | CCUCUUCAUCUUCUUCUUCAG |
| 4627 | 2419 | AGUGGGACUUGCCCUAUUGGU |
| 4628 | 2420 | GUGUUCCCAGUCUUUGUCCAU |
| 4629 | 2421 | AGGUUCAGAACCUGAACUCAC |
| 4630 | 2422 | GAGGAGGUCAAGCCUCUCCCA |
| 4631 | 2423 | CUGGUUGUUGACUGUUUCUUU |
| 4632 | 2424 | CCUAUGAGGAUUUCCUAGGUU |
| 4633 | 2425 | AAGGGUCACUGCUCCAAGGUC |
| 4634 | 2426 | CUAUUGAAAUUAGUGGGACUU |
| 4635 | 2427 | AAGAGAGAUCUCUGGGCGCUC |
| 4636 | 2428 | AACCCAAAGUCAGUCAAUUUA |
| 4637 | 2429 | CUAAUGAAUAGGGCUUCCUAA |
| 4638 | 2430 | UGGAUAUAUGGAUGGUUAGAU |
| 4639 | 2431 | UCCUAACCAGGUAUUGGGCUC |
| 4640 | 2432 | UCAUGACCAGAAUUUCAUUAA |
| 4641 | 2433 | AUAAGCCUAUGGAAUAAUUG |
| 4642 | 2434 | CAUCUCCUGAACAUAAACACG |
| 4643 | 2435 | UGAGAUACAAUUCUGAUAAAC |
| 4644 | 2436 | GAUCUCCUCAUCUGUCAUCUU |
| 4645 | 2437 | GUGACUUGCCUAGCGUCACAU |
| 4646 | 2438 | UAGAUGUUAUGAGUAUAAUCC |
| 4647 | 2439 | GUCACUAAUGUACUGAUUUUU |
| 4648 | 2440 | UCCAAGUUUCAAACUGCAAUA |
| 4649 | 2441 | AGCUUCUUUCUAAUACUUAUU |
| 4650 | 2442 | UCCUGGGUUCAAGCGAUUCUC |
| 4651 | 2443 | CGGACUGACAUUUCUUGGGAU |
| 4652 | 2444 | GGAAGAGGUACUUAGAGCCAA |
| 4653 | 2445 | CUUAUCAUCAAUAAUGAAUAU |
| 4654 | 2446 | GACUUCUCUAGGUAUAGGGUC |
| 4655 | 2447 | AGGCUAGUAUUUAUCCCACUA |
| 4656 | 2448 | AGAUGUGCCCUCGUUAUCUCA |
| 4657 | 2449 | UGUAGCCUUCACUGACCUCCC |
| 4658 | 2450 | UAUUCAUUUGAAAGGUAAAGA |
| 4659 | 2451 | AAUGAAUUGGAAGGCUGCCAC |
| 4660 | 2452 | CAAGCCUGAAAGAAAUCUGAA |
| 4661 | 2453 | CUGUGGUUGAGUGCUGAAGAA |
| 4662 | 2454 | AACUGAAUAUUAACUGCAAGU |
| 4663 | 2455 | GUAUGCUCAAAGUCUGAAGGA |
| 4664 | 2456 | AAAUAUCUCAAACUAUCAAAA |
| 4665 | 2457 | CUUGUCCUGUUGCAAUGUCUA |
| 4666 | 2458 | UGAAAGCCCUUCCUGAACACA |
| 4667 | 2459 | AAUAUCCUGUUGGACAAGAAA |
| 4668 | 2460 | UGAGGAUUUCCUAGGUUCAGA |
| 4669 | 2461 | ACAGAAAUAGGUGAUACAUAG |
| 4670 | 2462 | AGAAGCUCAAGUACAGUUAUA |
| 4671 | 2463 | UCUGCUGUAGGCAGGGCAUUG |
| 4672 | 2464 | CUAACUAUGAAUAGGGCUUC |
| 4673 | 2465 | UACCCAACAUGGUGACUGAUU |
| 4674 | 2466 | AGUCAUUACCCAACAUGGUGA |
| 4675 | 2467 | GAUUUCAGUAUUCUACAUUUA |
| 4676 | 2468 | CUCAACAUGUAAGGGAUGCUA |
| 4677 | 2469 | GGACAUCUAAUGACAAUGCAA |
| 4678 | 2470 | UCUUUCAUAGGAGAAAUAUUC |
| 4679 | 2471 | AUGUAGCCUUCACUGACCUCC |
| 4680 | 2472 | CUUCAUCCAUACAGGUCUCUG |
| 4681 | 2473 | AGGCUUAUAAGAAGUUUCUAU |
| 4682 | 2474 | GCAACAGAUGUUAUCAAGGGG |
| 4683 | 2475 | CAGUAGACAUCACUACCCUGU |
| 4684 | 2476 | CUGCUAUGUAUCCAUGUGCAC |
| 4685 | 2477 | CAAGAGAGGAUUAAUUUAGGU |
| 4686 | 2478 | UGUUUACUAUAUCACCUUUCU |
| 4687 | 2479 | AUCCAAAGCUUGCAGGCACUC |

TABLE 6-continued

Results for PAK3.
Score threshold: 70. Design: siRNA 21 nt.

| SEQ ID NO | siRNA_id | siRNA guide strand/ AS Sequence |
|---|---|---|
| 4688 | 2480 | AUGCAUGUUGGGUUAUAUUCA |
| 4689 | 2481 | AUGGACACACAAAUAUUUACA |
| 4690 | 2482 | AUUUCAUUAAUAAUUAAUUCC |
| 4691 | 2483 | CAGUCCUACAUAUUUGUUUAA |
| 4692 | 2484 | UGGUACUGCUGGUGAAGCAAU |
| 4693 | 2485 | ACCAGAUAUCAACUUUCGGAC |
| 4694 | 2486 | AGAAACAGCUUCUUUCUAAUA |
| 4695 | 2487 | GAGGUUUGAAUGCAAGAGGGA |
| 4696 | 2488 | ACCAUAGUGCUUCGUUUACUU |
| 4697 | 2489 | AACUCCCAGUUUACCCUCUUU |
| 4698 | 2490 | AAGAAUCCCGGUUGUUACUAU |
| 4699 | 2491 | CACACAAAUAUUUACAAUGAC |
| 4700 | 2492 | CUGUAUAAACAGUACCUGAUG |
| 4701 | 2493 | UUCCCAGUCCACAUGCAAAUA |
| 4702 | 2494 | GCAAUAUCUGCAACAGAUGUU |
| 4703 | 2495 | CAAAGAACUAAGCAUGAACAC |
| 4704 | 2496 | ACACGAUCUUUGAGCUGAGAA |
| 4705 | 2497 | UCCCAACAAAUUAAUUUGUCA |
| 4706 | 2498 | UGCCCUGCAUGCUCUGCGCUC |
| 4707 | 2499 | UUCUUGGGUUGCUGUUGAAGG |
| 4708 | 2500 | AGGCUUAGAGAAACAACUUUC |
| 4709 | 2501 | CUCAAUGCUAAUAGCAUGUAA |
| 4710 | 2502 | ACAUGGAGGUGAUAUCUCAGU |
| 4711 | 2503 | CAAGUCAUAUAAGGAAUUCUG |
| 4712 | 2504 | ACAUAAGAGACUCAGGCUUAA |
| 4713 | 2505 | AAGUGACCACUUUAUGGUCAC |
| 4714 | 2506 | AGAAGGAGAGAGGCCUAUGUA |
| 4715 | 2507 | UCCUGAACAUAAACACGUACA |
| 4716 | 2508 | GCUGAAUGUACAUAAGUUCUG |
| 4717 | 2509 | ACUGUGGAGUUGUCAUCAGA |
| 4718 | 2510 | CAUGGGAUUAUGACAACGCAC |
| 4719 | 2511 | CAGCUGCUAUCUGUCCUUCAU |
| 4720 | 2512 | AGAGAAUUUCAAGACAUUUAU |
| 4721 | 2513 | CUGACCUCCCAUUUCUUACAG |
| 4722 | 2514 | UCAGUUUACAAAUGCUGAAUU |
| 4723 | 2515 | AGAUCUUAUCAUCAAUAAUGA |
| 4724 | 2516 | ACUAUAUCACCUUUCUCUAGA |
| 4725 | 2517 | CAUAACUUCUAUUGAAAUUAG |
| 4726 | 2518 | GACUUCCACAUGUUCACACAG |
| 4727 | 2519 | AGCAGAGGGCAGACAACCUGU |
| 4728 | 2520 | ACUCAAUGCAUUAGUAGCUAC |
| 4729 | 2521 | CAUACAGGUCUCUGUGACCAC |
| 4730 | 2522 | CCCAGUAGACAUCACUACCCU |
| 4731 | 2523 | UGUGGGAGUUGUCAUCAGAAA |
| 4732 | 2524 | AUCAAACUGUCAGUUUACAAA |
| 4733 | 2525 | CUAUCAGAUACAAUGCCCUGA |
| 4734 | 2526 | CUUUACAUACAGACUGUAUGG |
| 4735 | 2527 | AGGCCCAUCAAACUGUCAGUU |
| 4736 | 2528 | AGAAUAUUGUCACUCUUUAUA |
| 4737 | 2529 | GAUCCUUCUCAACUUGUUUUG |
| 4738 | 2530 | CAGGAAAUCCAAAGCUUGCAG |
| 4739 | 2531 | CUUUAAUCCAAAGUUACAGAA |
| 4740 | 2532 | ACUCUAUUAGGGCAUGGACUU |
| 4741 | 2533 | UCUCUGCCCUGCAUGCUCUGC |
| 4742 | 2534 | CUAUCUUUGGUUCCCAACAAA |
| 4743 | 2535 | GUUACUAUUCAUCCUCAGUGG |
| 4744 | 2536 | UUCAAGUUACUCGAUUGUACC |
| 4745 | 2537 | UCAUUACCCAACAUGGUGACU |
| 4746 | 2538 | ACAAUAUUAGGGUUCUUAUUU |
| 4747 | 2539 | CAAAUUAAUUUGUCAACAUUU |
| 4748 | 2540 | UUCCACCACCCUAACACAACU |
| 4749 | 2541 | GUUCAGAGCUCAGAGACUGGG |
| 4750 | 2542 | ACUUCUCUAGGUAUAGGGUCU |
| 4751 | 2543 | CAUAUGUUUCAUAAGCACAAG |
| 4752 | 2544 | AACUGUAAAUGAAUUGGAAGG |
| 4753 | 2545 | CAAAGUGCUGGGAUUACAGGU |
| 4754 | 2546 | ACCAAGUAGCUAUCUAAAUAA |
| 4755 | 2547 | GUUAGAAGGAAGUUAUCCUUU |
| 4756 | 2548 | CAGAAGAUUCAGGAAGUGCCA |
| 4757 | 2549 | CACACAUAUUCCUCUCCACUU |
| 4758 | 2550 | GAAACAACUGUAAAUGAAUUG |
| 4759 | 2551 | GAUAUUAUAGAAUCUCUCAGA |
| 4760 | 2552 | GUCUAGUGCUGUAUAAACAGU |
| 4761 | 2553 | AUGCUGAGGUCAGAAGGAUGG |

TABLE 6-continued

Results for PAK3.
Score threshold: 70. Design: siRNA 21 nt.

| SEQ ID NO | siRNA_id | siRNA guide strand/ AS Sequence |
|---|---|---|
| 4762 | 2554 | ACCUUUGCUUAACUGAAUAUU |
| 4763 | 2555 | AAGCAAUAUUAUAACAAUAUC |
| 4764 | 2556 | AGGAUCAGGUGGUUAAACUCA |
| 4765 | 2557 | CUAUGGAUCACCUGGUUUGAG |
| 4766 | 2558 | UUCCCACUGCCCUAUUCCUAA |
| 4767 | 2559 | UACACAUGGUUUACAGAUAAC |
| 4768 | 2560 | ACUGCCCUAUUCCUAACUCAG |
| 4769 | 2561 | UGCACAAUCCAUAUUUCAAUU |
| 4770 | 2562 | CAGGAUGUCACAGUUUCAGUU |
| 4771 | 2563 | AACUCACCUAGCAGGAUGUCA |
| 4772 | 2564 | GAUCCUUGCUAACAACAUUAA |
| 4773 | 2565 | CACACCACACACAAGCACACA |
| 4774 | 2566 | AGGAGAAGCUCAAGUACAGUU |
| 4775 | 2567 | CCUGUUGCAAUGUCUAGUGCU |
| 4776 | 2568 | GUUGCAAUGUCUAGUGCUGUA |
| 4777 | 2569 | ACUUGAGUUAAAUCUUCUUAC |
| 4778 | 2570 | GCUAAUAGCAUGUAAUUACUU |
| 4779 | 2571 | UCCUCCUGGUAUGCCUAUUUU |
| 4780 | 2572 | CUGGAUCCUUGCUAACAACAU |
| 4781 | 2573 | UCCCUGACUUUCCCACUGCCC |
| 4782 | 2574 | CAAAUAUCUCAAACUAUCAAA |
| 4783 | 2575 | GUGACCACAUCAGUCAGAGAG |
| 4784 | 2576 | AAUAGGUGAUACAUAGGAAAA |
| 4785 | 2577 | UGCAAAUACACGUUCAGAAUU |
| 4786 | 2578 | GUAUUGGGCUCUCUCCACUGG |
| 4787 | 2579 | AUGUCUAGUGCUGUAUAAACA |
| 4788 | 2580 | GUCUCGAACUCCUGACCUCAG |
| 4789 | 2581 | AAACAACUUUCUGUAAUUUAC |
| 4790 | 2582 | UGGUGAAAUAGUAGUCAAAUU |
| 4791 | 2583 | ACUUACAUACAGACUGUAUG |
| 4792 | 2584 | UCCCGAGAAGAAUAUUGUCAC |
| 4793 | 2585 | ACAACCUGGUUUACUCAAUUA |
| 4794 | 2586 | UGUUGAUUCCUCUUGGGUAC |
| 4795 | 2587 | AUAAUUCCACCACCCUAACAC |
| 4796 | 2588 | CCACAUGUUCACACAGUACUU |
| 4797 | 2589 | UGGAGAGGUUAAGUGACUUGC |
| 4798 | 2590 | GAAAGAAAUCUGAAUAACAUA |
| 4799 | 2591 | AUCAUAAGUAAAUGAUGAUUA |
| 4800 | 2592 | GAGCUUUAUUUAGAUAUACAG |
| 4801 | 2593 | AGUUGUCAUCAGAAAUGCUAU |
| 4802 | 2594 | CCGGUUGUUACUAUUCAUCCU |
| 4803 | 2595 | GACAGUCCUACAUAUUUGUUU |
| 4804 | 2596 | CUCCUGGGAAGAUAGAGCGAA |
| 4805 | 2597 | AUGUGCCCUCGUUAUCUCAGG |
| 4806 | 2598 | AGUGACUUCUCUAGGUAUAGG |
| 4807 | 2599 | UGCUGUUUAUUUAAUUGUAAAG |
| 4808 | 2600 | GUGGGUUCUUCUUCUGUUCCA |
| 4809 | 2601 | CUUGCCUAGCGUCACAUAGCA |
| 4810 | 2602 | ACCCAGGCAAGCAUAAAGCCU |
| 4811 | 2603 | ACAUAUUUGUUUAAUGAUUUC |
| 4812 | 2604 | GUUAAACUCAAACAUUGGGGU |
| 4813 | 2605 | GCAUCUUUGAGAAACCUUUUU |
| 4814 | 2606 | UGUAAGGGAUGCUAACUAAUG |
| 4815 | 2607 | UUCCAAGUUCCAUUUUAUUUC |
| 4816 | 2608 | GUGCAUCUUUGAGAAACCUUU |
| 4817 | 2609 | CAAGAACGAAGUCAUUACCCA |
| 4818 | 2610 | AGGUCAAGCCUCUCCCAACUU |
| 4819 | 2611 | GUUCAGAACCUGAACUCACCU |
| 4820 | 2612 | CACGGUGGAAGUGACCACUUU |
| 4821 | 2613 | AUCUUGCAAGUUCAACCCAAU |
| 4822 | 2614 | UGGGCUCUGCUAUCUUGUGCC |
| 4823 | 2615 | CUAGGUUCAGAACCUGAACUC |
| 4824 | 2616 | CUAGCGUCACAUAGCAAUUUA |
| 4825 | 2617 | CACAUAUUCCUCUCCACUUUU |
| 4826 | 2618 | CUGAAUGAUAUACAGUAAUAU |
| 4827 | 2619 | AUGACCAGAAUUUCAUUAAUA |
| 4828 | 2620 | CACAGAACGAGUAUAGAUUGA |
| 4829 | 2621 | AAACCCAUUGAGCAAAGGAAU |
| 4830 | 2622 | UGGUACAAAGUGGUAGUAAAG |
| 4831 | 2623 | AACUCUAAAGAAAGUGCUUUC |
| 4832 | 2624 | AACAGAAAGAUUAUAUCAAAA |
| 4833 | 2625 | CUGAACUGAAAGCAUAAGAGA |
| 4834 | 2626 | AAGAUGUGCCCUCGUUAUCUC |
| 4835 | 2627 | UCCCUAGCUUUAACUUAUAGA |

TABLE 6-continued

Results for PAK3.
Score threshold: 70. Design: siRNA 21 nt.

| SEQ ID NO | siRNA_id | siRNA guide strand/ AS Sequence |
|---|---|---|
| 4836 | 2628 | CAUUUCUCAAUGCUAAUAGCA |
| 4837 | 2629 | CAAAUUAAUAUUACCGUUUCA |
| 4838 | 2630 | AGCCCUUCCUGAACACACAUA |
| 4839 | 2631 | UAUGGAUCACCUGGUUUGAGU |
| 4840 | 2632 | UGUGGGUUCUUCUUCUGUUCC |
| 4841 | 2633 | AGCUUGCAGGCACUCUCUGCA |
| 4842 | 2634 | AAUAUCAUUUAUAGACAAAUA |
| 4843 | 2635 | CUCCUGAACAUAAACACGUAC |
| 4844 | 2636 | AAUGGAUUCAACCACAGAACG |
| 4845 | 2637 | AAUUUCCCGGCACUAUGAGUG |
| 4846 | 2638 | AGUAUUUAUCCCACUACAUCU |
| 4847 | 2639 | AUUUCACCGUUUGAGCUUUAU |
| 4848 | 2640 | AUUUAGUAAUAAAGCUCAUAU |
| 4849 | 2641 | ACUUGUAAGUGUUUAGGUUCA |
| 4850 | 2642 | CUCUCCAAUACAGGGAAGGGG |
| 4851 | 2643 | CUUUCUAAUACUUAUUAGAAA |
| 4852 | 2644 | UGCCCUCGUUAUCUCAGGGCA |
| 4853 | 2645 | ACUCUAAAGAAAGUGCUUUCA |
| 4854 | 2646 | AUAUUCCGAAACAGAAAUAGG |
| 4855 | 2647 | UCACAAGCCUGAAAGAAAUCU |
| 4856 | 2648 | AGGAUCAUCUAGUCCAAUACA |
| 4857 | 2649 | ACCUCUUUAUUUGGUACUGCU |
| 4858 | 2650 | AUCCCUGUUUAUGUUAUUUAA |
| 4859 | 2651 | AGUUUCAAACUGCAAUAUUUU |
| 4860 | 2652 | AGAUUGGAUGCUGAGGUCAGA |
| 4861 | 2653 | ACACUCAAGACACAGUCAUGC |
| 4862 | 2654 | GUGGAUCCUUCUCAACUUGUU |
| 4863 | 2655 | AUGACUACCCAUAGUUCAUCA |
| 4864 | 2656 | AUAUCACCUUUCUCUAGAUCU |
| 4865 | 2657 | GUUAUAUUCUAGCAAGUGUGA |
| 4866 | 2658 | AAAGCAGAGGGCAGACAACCU |
| 4867 | 2659 | ACAAGGAUUUCAGUAUUCUAC |
| 4868 | 2660 | GAAUGUACAUAAGUUCUGUUU |
| 4869 | 2661 | ACAGAACUAUAACUGAAUGCC |
| 4870 | 2662 | AAUCCUACCUGAAUGAUAUAC |
| 4871 | 2663 | UGAGUUAGAAGGAAGUUAUCC |
| 4872 | 2664 | ACUUAAUGUCCAACAAGGAUU |
| 4873 | 2665 | AAUUUGCAAGGCAACCUAUAA |
| 4874 | 2666 | UCUCUGCAGACAGCUGCUAUC |
| 4875 | 2667 | ACUUGAGAAUUAAACUCUAGA |
| 4876 | 2668 | ACUGCAAGUAGCUUAGAUAAA |
| 4877 | 2669 | CUCUCUCUCAUUAGAGCAGUG |
| 4878 | 2670 | CACAUGAAUCGUAUGCUCAAA |
| 4879 | 2671 | AUCUUGGUACAAAGUGGUAGU |
| 4880 | 2672 | GAGACUGGGAGAUACUUGCAC |
| 4881 | 2673 | UGUAAGGAUCAGGUGGUUAAA |
| 4882 | 2674 | CUUAUUCUUCUCUUCAGGGGC |
| 4883 | 2675 | UCUUACUCAUGAGGGAGAUGG |
| 4884 | 2676 | AAGUUACUCGAUUGUACCAAA |
| 4885 | 2677 | CGGAAUACAGCUGACAGUCUC |
| 4886 | 2678 | UGUGACCUCUUUAUUUGGUAC |
| 4887 | 2679 | GUAUAGAAUACUCUGUACACAC |
| 4888 | 2680 | CAUUGUUUAAUAUUAAACACA |
| 4889 | 2681 | UAAGCACAAGAGAGGAUUAAU |
| 4890 | 2682 | CACAUCCAUCUCAAGACAGCG |
| 4891 | 2683 | GAUGUAGCCUUCACUGACCUC |
| 4892 | 2684 | CUUUGUCCAUAUGCAUUUCUU |
| 4893 | 2685 | CAGGGAAAGAGAAUAAACUGU |
| 4894 | 2686 | UAAUGACAAUGCAAGUGAAAA |
| 4895 | 2687 | ACUUCAUUUGCUUGAGUUUUU |
| 4896 | 2688 | CUCAGAGAAAGUCCCAUCUUU |
| 4897 | 2689 | AUCUAUUUCCUCCUGGUAUGC |
| 4898 | 2690 | AGGUAUCAUUAUCUUUGUUUA |
| 4899 | 2691 | CAAAGAUUUGGAUAGACUCAC |
| 4900 | 2692 | UGCUUCUCACCCUUCCCUGAC |
| 4901 | 2693 | UCUGGAAUUCCAGUGAAUUCC |
| 4902 | 2694 | UGCUGAACUGAAAGCAUAAGA |
| 4903 | 2695 | GUAUCAUAAGUAAAUGAUGAU |
| 4904 | 2696 | GUUAUAUUCAUUUGGUCACUU |
| 4905 | 2697 | CAAAGUCAGUCAAUUUAACAG |
| 4906 | 2698 | CACCUUUCUCUAGAUCUUUAA |
| 4907 | 2699 | GUGCAGGAAAUCCAAAGCUUG |
| 4908 | 2700 | GUCAACAUUUCUCAAUGCUAA |
| 4909 | 2701 | CACACACAAGCACACACAUUG |

TABLE 6-continued

Results for PAK3.
Score threshold: 70. Design: siRNA 21 nt.

| SEQ ID NO | siRNA_id | siRNA guide strand/ AS Sequence |
|---|---|---|
| 4910 | 2702 | GCUAUCAGAUACAAUGCCCUG |
| 4911 | 2703 | UGUAAUCCCUGUUUAUGUUAU |
| 4912 | 2704 | CUAAGUAUUCUGUAUUGAGA |
| 4913 | 2705 | ACAGUACUUGCUCUGGUAUUU |
| 4914 | 2706 | ACCAUCCACUAACUCCCAGUU |
| 4915 | 2707 | CAGAAGGAUGGAACCAUACCA |
| 4916 | 2708 | UGGUAUUUGCGGGUCCAUAAA |
| 4917 | 2709 | UGAAUGAUAUACAGUAAUAUC |
| 4918 | 2710 | UGCUUCAACCACAAUUUAAAA |
| 4919 | 2711 | CAUGAUCUCAGCUCACCACAA |
| 4920 | 2712 | CAGUCCUCUUGUUCAGAGCUC |
| 4921 | 2713 | AAUCCCGGUUGUUACUAUUCA |
| 4922 | 2714 | AUAUAAUUAUUUACACGAUCU |
| 4923 | 2715 | GCUGUUCUUAAUUGCUUCCUU |
| 4924 | 2716 | UUGCUGCCCUGUUUGGGCUGC |
| 4925 | 2717 | UCAGGUAUUAAGGAGAUUAAC |
| 4926 | 2718 | UCUCAGGGCACACUAGCAACA |
| 4927 | 2719 | ACUGUUUCUUUGGAAUCAUAG |
| 4928 | 2720 | CUCAGGGCACACUAGCAACAU |
| 4929 | 2721 | CUGUAAAUGAAUUGGAAGGCU |
| 4930 | 2722 | AAGUUACAGAAGAAUUUCACU |
| 4931 | 2723 | AGAGAGGAUUAAUUUAGGUAU |
| 4932 | 2724 | UCUAUUAGGGCAUGGACUUCC |
| 4933 | 2725 | UGGUUCCCAACAAAUUAAUUU |
| 4934 | 2726 | GACAUUUAUGAAUAUGCUUUU |
| 4935 | 2727 | ACCAACAGAAAGAUUAUAUCA |
| 4936 | 2728 | GUUCCUGUACAAAGUACUGGA |
| 4937 | 2729 | ACAUGUUCACACAGUACUUGC |
| 4938 | 2730 | UGCUAAUAGCAUGUAAUUACU |
| 4939 | 2731 | AUAGAUAUAUGGUGAAAUAGU |
| 4940 | 2732 | GUACAGUUAUAUUCUAGCAAG |
| 4941 | 2733 | UAGCGGCUGCUGUUCUUAAUU |
| 4942 | 2734 | CACCGUUUGAGCUUUAUUUAG |
| 4943 | 2735 | ACCAUACCAUCAGCAGGUCUA |
| 4944 | 2736 | CAAGACAUUUAUGAAUAUGCU |
| 4945 | 2737 | GACUGGGAGAUACUUGCACUA |
| 4946 | 2738 | CUUGUAAGUGUUUAGGUUCAC |

TABLE 6-continued

Results for PAK3.
Score threshold: 70. Design: siRNA 21 nt.

| SEQ ID NO | siRNA_id | siRNA guide strand/ AS Sequence |
|---|---|---|
| 4947 | 2739 | AGUAAUCGUGCCCAUUGCUCU |
| 4948 | 2740 | UAAGAGACUCAGGCUUAAACG |
| 4949 | 2741 | ACAUGCAAAUACACGUUCAGA |
| 4950 | 2742 | AAUCCAAAGUUACAGAAGAAU |
| 4951 | 2743 | UCUUUCGCUUCACGGUGGAAG |
| 4952 | 2744 | AUGCUCAAAGUCUGAAGGAAG |
| 4953 | 2745 | AUGGAACAUGGACACACAAAU |
| 4954 | 2746 | AUCAACUUUCGGACCAUAAGC |
| 4955 | 2747 | AGUUACAACUAAUUUCACAGC |
| 4956 | 2748 | AGAUAACACAUUCUGACAAAA |
| 4957 | 2749 | UCCAAUACAAAUGCAGAAAAA |
| 4958 | 2750 | AGCUCAUGUAUUUCUGGUUGU |
| 4959 | 2751 | UCCCAGGAUUUCAUUGAAUUU |
| 4960 | 2752 | CGCUCUUUCUCCUUCUUCUUA |
| 4961 | 2753 | ACAGGAAAGGAGAAGCUCAAG |
| 4962 | 2754 | AGAAUAAACUGUUAACAAUCU |
| 4963 | 2755 | CACAGGAAAGGAGAAGCUCAA |
| 4964 | 2756 | UUCCUCCUGGUAUGCCUAUUU |
| 4965 | 2757 | CAUCUUUCCUGCAGCAGAGUU |
| 4966 | 2758 | CUAGGCUAGUAUUUAUCCCAC |
| 4967 | 2759 | AGAAGAAUCCUACCUGAAUGA |
| 4968 | 2760 | ACCCUAACACAACUGAUUUCA |
| 4969 | 2761 | ACUCUCAGAAGAUUCAGGAAG |
| 4970 | 2762 | AGAGAUCUCUGGGCGCUCUUU |
| 4971 | 2763 | AAAUAUCAUUUAUAGACAAAU |
| 4972 | 2764 | UCCCAAUGCAUGUUGGGUUAU |
| 4973 | 2765 | GUUCUAAUAGUGACAUCUCCC |
| 4974 | 2766 | AUAUCCUGUUGGACAAGAAAA |
| 4975 | 2767 | AUUAUAGAAUCUCUCAGAACU |
| 4976 | 2768 | UCAGGCUUACAAAUAAAUUAC |
| 4977 | 2769 | AUCUCUGGGCGCUCUUUCUCC |
| 4978 | 2770 | CUCUCUCAUUAGAGCAGUGUG |
| 4979 | 2771 | CUCAGGUGAUCCGCCUGCCUU |
| 4980 | 2772 | AGGAGUGAUCUGGGCACAGAA |
| 4981 | 2773 | AUUUCCCGGCACUAUGAGUGA |
| 4982 | 2774 | CCAAUCUAAAGCAACCACAAA |
| 4983 | 2775 | CUAAGAUCUCCUCAUCUGUCA |

TABLE 6-continued

Results for PAK3.
Score threshold: 70. Design: siRNA 21 nt.

| SEQ ID NO | siRNA_id | siRNA guide strand/ AS Sequence |
|---|---|---|
| 4984 | 2776 | UGGAGGUGAUAUCUCAGUUCC |
| 4985 | 2777 | CUUCCACAUGUUCACACAGUA |
| 4986 | 2778 | AGAUGGAUGGAUGUACCUUGG |
| 4987 | 2779 | ACUGCUGGUAUUAUGGGAUAG |
| 4988 | 2780 | UGCUCGGUCUUGGUGCGAUA |
| 4989 | 2781 | AAUAUCUCAAACUAUCAAAAC |
| 4990 | 2782 | AACUCUAUUAGGGCAUGGACU |
| 4991 | 2783 | GAAUAUUAACUGCAAGUAGCU |
| 4992 | 2784 | CCAUAAAUACCUUUAAUCCAA |
| 4993 | 2785 | AAGGAUCAGGUGGUUAAACUC |
| 4994 | 2786 | CUCUCUGCAGACAGCUGCUAU |
| 4995 | 2787 | GAGGGAGUGUGCAUCUUUGAG |
| 4996 | 2788 | UCUUAUCAUCAAUAAUGAAUA |
| 4997 | 2789 | UAAUGAAUAGGGCUUCCUAAC |
| 4998 | 2790 | CCUAGGCUAGUAUUUAUCCCA |
| 4999 | 2791 | AACUUUCUGUAAUUUACAAAA |
| 5000 | 2792 | AUUGAGCAAAGGAAUAUAAUU |
| 5001 | 2793 | AUUCUGAUAAACAAUGAAAAC |
| 5002 | 2794 | AGGCAGAGACAGUCCUACAUA |
| 5003 | 2795 | ACACAGGUGUGCACAUGGAGG |
| 5004 | 2796 | AUUAGGGCAUGGACUUCCACA |
| 5005 | 2797 | GACCAAGAGAUUCAACCGGGG |
| 5006 | 2798 | AGAAAUGCUAUCUUUGGUUCC |
| 5007 | 2799 | GUAAGUGUUUAGGUUCACUCU |
| 5008 | 2800 | AGCAUGAACACACCAUAUUCC |
| 5009 | 2801 | CCAACAGAAAGAUUAUAUCAA |
| 5010 | 2802 | ACCUGAAUGAUAUACAGUAAU |
| 5011 | 2803 | AAGGGAUGCUAACUAAUGAAU |
| 5012 | 2804 | CACAGGUGUGCACAUGGAGGU |
| 5013 | 2805 | CUUCUCAACAUGUAAGGGAUG |
| 5014 | 2806 | UGCUGGUAUUAUGGGAUAGCA |
| 5015 | 2807 | CUGGAGAGAAUUUCAAGACAU |
| 5016 | 2808 | GAAGAAUCCUACCUGAAUGAU |
| 5017 | 2809 | AUGUAAAGCUCAUGUAUUUCU |
| 5018 | 2810 | AUAGUAUGCUUCAAAUUAAUA |
| 5019 | 2811 | AUGGUGAAAUAGUAGUCAAAU |
| 5020 | 2812 | GUCUCUGUGACCACAUCAGUC |
| 5021 | 2813 | GCAUGAACACACCAUAUUCCG |
| 5022 | 2814 | CUUGGUACAAAGUGGUAGUAA |
| 5023 | 2815 | CAUGGGCUCUGCUAUCUUGUG |
| 5024 | 2816 | GCCUAUGUAACUGAUCUCUUU |
| 5025 | 2817 | AAAGAGAAUAAACUGUUAACA |
| 5026 | 2818 | AGUUAGACAUUGUUUAAUAUU |
| 5027 | 2819 | ACCCACCAAGUAGCUAUCUAA |
| 5028 | 2820 | GAUGCUAACUAAUGAAUAGGG |
| 5029 | 2821 | CUAUUCCUAACUCAGGACAUU |
| 5030 | 2822 | AGGAAGUUAUCCUUUGGUUAG |
| 5031 | 2823 | AUGGUGAGGUGUAAGGCUUGC |
| 5032 | 2824 | UCUGGGCGCUCUUUCUCCUUC |
| 5033 | 2825 | AGCUCACCACAACCUCCGCCU |
| 5034 | 2826 | UCAGUUAGACAUUGUUUAAUA |
| 5035 | 2827 | CAGUCUUUGUCCAUAUGCAUU |
| 5036 | 2828 | UUCAUCCUCAGUGGAGGAGCC |
| 5037 | 2829 | ACUGUAAAUGAAUUGGAAGGC |
| 5038 | 2830 | AGUAAAUGAUGAUUAAUGUAU |
| 5039 | 2831 | AGUAAUAAAGCUCAUAUUAGA |
| 5040 | 2832 | UCCUAGGUUCAGAACCUGAAC |
| 5041 | 2833 | AUGCUACAAGUUGUAUAGAAU |
| 5042 | 2834 | GAUACAAUUCUGAUAAACAAU |
| 5043 | 2835 | CAGAGGGCAGACAACCUGUUU |
| 5044 | 2836 | GCUUGCAGGCACUCUCUGCAG |
| 5045 | 2837 | AGUCACCACCUCAGGUGCCAU |
| 5046 | 2838 | CUGCCCUGCAUGCUCUGCGCU |
| 5047 | 2839 | GGGACCAUCCACUAACUCCCA |
| 5048 | 2840 | CAUUAGUAGCUACAGGAUUCU |
| 5049 | 2841 | AGGCAAUAUCUGCAACAGAUG |
| 5050 | 2842 | AGGAUUAAUUUAGGUAUCAUU |
| 5051 | 2843 | GAUUCAACCACAGAACGAGUA |
| 5052 | 2844 | CAUCACAUUGGGUAAGGAGUU |
| 5053 | 2845 | UGUUGACUGUUUCUUUGGAAU |
| 5054 | 2846 | ACAAAUGCUGAAUUUCAGUCC |
| 5055 | 2847 | UGAGUAUAAUCCCAGUAGACA |
| 5056 | 2848 | UGUGCUGAGUUCACUUCAAAU |
| 5057 | 2849 | ACCACCCUAACACAACUGAUU |

TABLE 6-continued

Results for PAK3.
Score threshold: 70. Design: siRNA 21 nt.

| SEQ ID NO | siRNA_id | siRNA guide strand/AS Sequence |
|---|---|---|
| 5058 | 2850 | CUACUCUCAGAAGAUUCAGGA |
| 5059 | 2851 | CAAAGCUUGCAGGCACUCUCU |
| 5060 | 2852 | GAAACAACUUUCUGUAAUUUA |

TABLE 7

Results for TRNP1. Score threshold: 70.
Design: siRNA 21 nt.

| SEQ ID NO | siRNA_id | siRNA guide strand/AS Sequence |
|---|---|---|
| 5061 | 1 | UUUAAUGAGGAAGACUUCCUG |
| 5062 | 2 | UCAAUUCUCAACGUCUUCCUG |
| 5063 | 3 | UUGUUUAAGAAUGAUGACGAU |
| 5064 | 4 | UAAUCUGAUUGCAUCUCAGGG |
| 5065 | 5 | UUAGACUUGAAGCAAUGACAU |
| 5066 | 6 | UUAAUGAGGAAGACUUCCUGA |
| 5067 | 7 | UAAUUCAAUAUACAUUCACUA |
| 5068 | 8 | UAUGGAAAUUUAUUCCUCCUG |
| 5069 | 9 | AACGAAACUAAAUACAAGCUG |
| 5070 | 10 | UAGAGUGGAGGUUCUGAGGAG |
| 5071 | 11 | AUGCUUGCUACGCUUAAUCUG |
| 5072 | 12 | UGUAGCAACAUCUCCAAUUGU |
| 5073 | 13 | UAGGAGUCAAGGUCGGAGUUG |
| 5074 | 14 | UUAAUCUGAUUGCAUCUCAGG |
| 5075 | 15 | UAAUGAGGAAGACUUCCUGAG |
| 5076 | 16 | UAAGGCAGGAGACUAAUUCAA |
| 5077 | 17 | AUCCGUAGUCCUUCCAGCCGG |
| 5078 | 18 | UAGACUUGAAGCAAUGACAUC |
| 5079 | 19 | UGUAAGGUCAAUUCUCAACGU |
| 5080 | 20 | AACAUCUCCAAUUGUACAGUG |
| 5081 | 21 | UAUAUGAAGAAAUUCAGAGCA |
| 5082 | 22 | AAUCUGAUUGCAUCUCAGGGA |
| 5083 | 23 | UCAAUAUACAUUCACUAUGCA |
| 5084 | 24 | ACUAAAUACAAGCUGCUCCAG |
| 5085 | 25 | AAUUCUACAAGUUCUGGGCUA |
| 5086 | 26 | UUGGUCUGCAAAUCAAAGUCA |
| 5087 | 27 | UGCAGAAUUCUACAAGUUCUG |
| 5088 | 28 | UGAAGCAAUGACAUCUAUUAA |
| 5089 | 29 | UGGUCUGCAAAUCAAAGUCAA |

TABLE 7-continued

Results for TRNP1. Score threshold: 70.
Design: siRNA 21 nt.

| SEQ ID NO | siRNA_id | siRNA guide strand/AS Sequence |
|---|---|---|
| 5090 | 30 | UUAUGGAAAUUUAUUCCUCCU |
| 5091 | 31 | UAUACAUUCACUAUGCAGAAU |
| 5092 | 32 | UCACUAUGCAGAAUUCUACAA |
| 5093 | 33 | UUGCAUCUCAGGGACCUGUAG |
| 5094 | 34 | AGGAUGACCACAGCACACCCG |
| 5095 | 35 | UAAAGUGAAAGGCUCCUGUGA |
| 5096 | 36 | AAGAAUGAUGACGAUAUCUUG |
| 5097 | 37 | AUAGACACAGAGGAAAGGCAG |
| 5098 | 38 | UGAAGAAAUUCAGAGCAUCAG |
| 5099 | 39 | UGAUUGCAUCUCAGGGACCUG |
| 5100 | 40 | UUAUCAGGAUGUUUAAAUGUG |
| 5101 | 41 | ACUUGAAGCAAUGACAUCUAU |
| 5102 | 42 | AUAUGAAGAAAUUCAGAGCAU |
| 5103 | 43 | UCGGUCGGUCGGCACCUCGGC |
| 5104 | 44 | AUCCAUAGAGUGGAGGUUCUG |
| 5105 | 45 | AAUCCAGAGGUCCAGAUCCAU |
| 5106 | 46 | UGCAAAUCAAAGUCAACAGGG |
| 5107 | 47 | UCUUCCUGAAGGCAGUGCCCA |
| 5108 | 48 | UACAAGCUGCUCCAGGAACCG |
| 5109 | 49 | UUGAAGCAAUGACAUCUAUUA |
| 5110 | 50 | AAGGUCAAUUCUCAACGUCUU |
| 5111 | 51 | AUAUACAUUCACUAUGCAGAA |
| 5112 | 52 | UCAACGUCUUCCUGAAGGCAG |
| 5113 | 53 | AAGCCGAAUCCAGAGGUCCAG |
| 5114 | 54 | AUGAGGAAGACUUCCUGAGGA |
| 5115 | 55 | AUCACAUCCUUUAAUGAGGAA |
| 5116 | 56 | UCCUGCGGAUCCGUAGUCCUU |
| 5117 | 57 | UUGGAAGGAGCUCAGCCUCCU |
| 5118 | 58 | AUAGAGUGGAGGUUCUGAGGA |
| 5119 | 59 | AAUCAAAGUCAACAGGGCCAG |
| 5120 | 60 | AAAUACAAGCUGCUCCAGGAA |
| 5121 | 61 | UCAGUCGGUCGGUCGGCACCU |
| 5122 | 62 | ACAAGCUGCUCCAGGAACCGU |
| 5123 | 63 | UGAGGAAGACUUCCUGAGGAG |
| 5124 | 64 | AAAGUGAACCUCAGAACCCCA |
| 5125 | 65 | CAAUUGUACAGUGUAAGCCAA |
| 5126 | 66 | ACCUCGGCGAAGCUUGUCGGG |

TABLE 7-continued

Results for TRNP1. Score threshold: 70.
Design: siRNA 21 nt.

| SEQ ID NO | siRNA_id | siRNA guide strand/AS Sequence |
|---|---|---|
| 5127 | 67 | UGGAAAUUUAUUCCUCCUGAA |
| 5128 | 68 | UAAGAAUGAUGACGAUAUCUU |
| 5129 | 69 | UUAAGAAUGAUGACGAUAUCU |
| 5130 | 70 | UAAAUACAAGCUGCUCCAGGA |
| 5131 | 71 | AAUUUAUUCCUCCUGAAUGUA |
| 5132 | 72 | ACUAAUUCAAUAUACAUUCAC |
| 5133 | 73 | AACGUCUUCCUGAAGGCAGUG |
| 5134 | 74 | AACUAAAUACAAGCUGCUCCA |
| 5135 | 75 | UCCUCCUGAAUGUAUAAGGCA |
| 5136 | 76 | AUUCAAUAUACAUUCACUAUG |
| 5137 | 77 | AAUUCAAUAUACAUUCACUAU |
| 5138 | 78 | UAAUAGACACAGAGGAAAGGC |
| 5139 | 79 | UAUGCAGAAUUCUACAAGUUC |
| 5140 | 80 | AUCUCCAAUUGUACAGUGUAA |
| 5141 | 81 | CAAUAUACAUUCACUAUGCAG |
| 5142 | 82 | UUGCUACGCUUAAUCUGAUUG |
| 5143 | 83 | CUUAAUCGAUUGCAUCUCAG |
| 5144 | 84 | UUCACUAUGCAGAAUUCUACA |
| 5145 | 85 | ACCGUCAACUUAAAGAGCCAU |
| 5146 | 86 | UUCCUGCGGAUCCGUAGUCCU |
| 5147 | 87 | AUUCUCAACGUCUUCCUGAAG |
| 5148 | 88 | UCAAGGGAGAAUUGGUCUGCA |
| 5149 | 89 | UGCGGAUCCGUAGUCCUUCCA |
| 5150 | 90 | UCUGCAAAUCAAAGUCAACAG |
| 5151 | 91 | UUGCCUUACAUUAUGGAAAUU |
| 5152 | 92 | AGCUGCUCCAGGAACCGUCAA |
| 5153 | 93 | AACCGUCAACUUAAAGAGCCA |
| 5154 | 94 | UGCUCCAGGAACCGUCAACUU |
| 5155 | 95 | UGCCUCUUCCUGCGGAUCCGU |
| 5156 | 96 | ACCGUAGCAACAUCUCCAAU |
| 5157 | 97 | UCCAGCUCCGACACCAGGCGC |
| 5158 | 98 | UCUGCGGCUGUAGGUGCGCAG |
| 5159 | 99 | AAUUCUCAACGUCUUCCUGAA |
| 5160 | 100 | AGAAAUUCAGAGCAUCAGCCA |
| 5161 | 101 | UAUUCCUCCUGAAUGUAUAAG |
| 5162 | 102 | UGGAGAACAAGGGCAGUGGAU |
| 5163 | 103 | UUAAGAAUGUUGUUUAAGAAU |
| 5164 | 104 | UAAGGUCAAUUCUCAACGUCU |
| 5165 | 105 | GACCUGUAGCAACAUCUCCAA |
| 5166 | 106 | UGCAGCUGCAGCACGCGGCUC |
| 5167 | 107 | CAGAAUUCUACAAGUUCUGGG |
| 5168 | 108 | AUGUUGUUUAAGAAUGAUGAC |
| 5169 | 109 | UGCUUGCUACGCUUAAUCUGA |
| 5170 | 110 | UUCAAUAUACAUUCACUAUGC |
| 5171 | 111 | UAGCAACAUCUCCAAUUGUAC |
| 5172 | 112 | UCCAAUUGUACAGUGUAAGCC |
| 5173 | 113 | UUAUUCCUCCUGAAUGUAUAA |
| 5174 | 114 | UUCUUGAGGCGCGACCCGUGA |
| 5175 | 115 | UGUUGUUUAAGAAUGAUGACG |
| 5176 | 116 | AAAGUGAAAGGCUCCUGUGAG |
| 5177 | 117 | AAAUCAAAGUCAACAGGGCCA |
| 5178 | 118 | AGAAUGUUGUUUAAGAAUGAU |
| 5179 | 119 | UGGAGGUUCUGAGGAGUUGGA |
| 5180 | 120 | ACAUUAUGGAAAUUUAUUCCU |
| 5181 | 121 | AUCUGAUUGCAUCUCAGGGAC |
| 5182 | 122 | UAUGAAGAAAUUCAGAGCAUC |
| 5183 | 123 | UUACAUUAUGGAAAUUUAUUC |
| 5184 | 124 | AAUGAUGACGAUAUCUUGAAA |
| 5185 | 125 | ACAUCUCCAAUUGUACAGUGU |
| 5186 | 126 | UGGAGGUCAGCGCUGCGGGA |
| 5187 | 127 | GAAAUUCAGAGCAUCAGCCAG |
| 5188 | 128 | UCCACCUCCAGCAGCCGCCGC |
| 5189 | 129 | UCUUGAGGCGCGACCCGUGAG |
| 5190 | 130 | UGCAUUUGCCUUACAUUAUGG |
| 5191 | 131 | AUGCAUUUGCCUUACAUUAUG |
| 5192 | 132 | UACAUUAUGGAAAUUUAUUCC |
| 5193 | 133 | UGUAAGUGAAAGGCUCCUGU |
| 5194 | 134 | UCCGUAGUCCUUCCAGCCGGC |
| 5195 | 135 | AAACGAAACUAAAUACAAGCU |
| 5196 | 136 | UCUCCAAUUGUACAGUGUAAG |
| 5197 | 137 | UCCGCGAUCAGUCGGUCGGUC |
| 5198 | 138 | UGGAAGGAGCUCAGCCUCCUC |
| 5199 | 139 | AUAAUAGACACAGAGGAAAGG |
| 5200 | 140 | AUGGAAAUUUAUUCCUCCUGA |

TABLE 7-continued

Results for TRNP1. Score threshold: 70.
Design: siRNA 21 nt.

| SEQ ID NO | siRNA_id | siRNA guide strand/AS Sequence |
|---|---|---|
| 5201 | 141 | UCUUCCUGCGGAUCCGUAGUC |
| 5202 | 142 | AUUGCAUCUCAGGGACCUGUA |
| 5203 | 143 | UCCUGAAUGUAUAAGGCAGGA |
| 5204 | 144 | UUCUCAACGUCUUCCUGAAGG |
| 5205 | 145 | AGAAUGAUGACGAUAUCUUGA |
| 5206 | 146 | AUUAUCAGGAUGUUUAAAUGU |
| 5207 | 147 | UCCGUCAUCACAUCCUUUAAU |
| 5208 | 148 | CACCCGAACAGCUAGACACGG |
| 5209 | 149 | AAUAGACACAGAGGAAAGGCA |
| 5210 | 150 | UCCUUUAAUGAGGAAGACUUC |
| 5211 | 151 | GUAAGGUCAAUUCUCAACGUC |
| 5212 | 152 | UUCUACAAGUUCUGGGCUAUG |
| 5213 | 153 | AUGCAGAAUUCUACAAGUUCU |
| 5214 | 154 | UCCCUCAAACAGGCCUCCCGG |
| 5215 | 155 | UUCCUGAAGGCAGUGCCCAGG |
| 5216 | 156 | GUAGCAACAUCUCCAAUUGUA |
| 5217 | 157 | UUUAUUCCUCCUGAAUGUAUA |
| 5218 | 158 | AUUCACUAUGCAGAAUUCUAC |
| 5219 | 159 | ACAUUCACUAUGCAGAAUUCU |
| 5220 | 160 | UACGCUUAAUCUGAUUGCAUC |
| 5221 | 161 | CAAUUCUCAACGUCUUCCUGA |
| 5222 | 162 | UCCGACACCAGGCGCCGGCGG |
| 5223 | 163 | CACAGCACACCCGAACAGCUA |
| 5224 | 164 | UCCCACGUGGAGAACAAGGGC |
| 5225 | 165 | AAUGAGGAAGACUUCCUGAGG |
| 5226 | 166 | ACAAGCACACUCCCACGUGGA |
| 5227 | 167 | UCCAGAUCCAUAGAGUGGAGG |
| 5228 | 168 | AAGAAUGUUGUUUAAGAAUGA |
| 5229 | 169 | CUAUGCAGAAUUCUACAAGUU |
| 5230 | 170 | UUCCUCCUGAAUGUAUAAGGC |
| 5231 | 171 | UGAGGAGUUGGAAGGAGCUCA |
| 5232 | 172 | UCCAUAGAGUGGAGGUUCUGA |
| 5233 | 173 | UGUUUAAGAAUGAUGACGAUA |
| 5234 | 174 | UUUAAGAAUGAUGACGAUAUC |
| 5235 | 175 | AUGUAUAAGGCAGGAGACUAA |
| 5236 | 176 | CUACGCUUAAUCUGAUUGCAU |
| 5237 | 177 | UCCUGGUCCUCGGCCGCGCCU |
| 5238 | 178 | ACUUGCAAAGUGAACCUCAGA |
| 5239 | 179 | AUUGGUCUGCAAAUCAAAGUC |
| 5240 | 180 | CAUCUCAGGGACCUGUAGCAA |
| 5241 | 181 | UGAGGCGCGACCCGUGAGCCG |
| 5242 | 182 | UAGGUGCGCAGGGAGGAUGAC |
| 5243 | 183 | AGUCGGUCGGUCGGCACCUCG |
| 5244 | 184 | AAACUAAAUACAAGCUGCUCC |
| 5245 | 185 | CAGAGGUCCAGAUCCAUAGAG |
| 5246 | 186 | UCCAUUAUCAGGAUGUUUAAA |
| 5247 | 187 | ACAGCACACCCGAACAGCUAG |
| 5248 | 188 | UAAGAAUGUUGUUUAAGAAUG |
| 5249 | 189 | AGUUGGAAGGAGCUCAGCCUC |
| 5250 | 190 | UCAGGUCAAGGGAGAAUUGGU |
| 5251 | 191 | UGCGGCUGUAGGUGCGCAGGG |
| 5252 | 192 | UCCUGUGAGGAGGCGCUGGG |
| 5253 | 193 | UCACAUCCUUUAAUGAGGAAG |
| 5254 | 194 | AUUCUACAAGUUCUGGGCUAU |
| 5255 | 195 | AUUUAUUCCUCCUGAAUGUAU |
| 5256 | 196 | UCGGUCGGCACCUCGGCGAAG |
| 5257 | 197 | GAAACUAAAUACAAGCUGCUC |
| 5258 | 198 | GUCCGCGAUCAGUCGGUCGGU |
| 5259 | 199 | UCUGAGGAGUUGGAAGGAGCU |
| 5260 | 200 | UGAAUGUAUAAGGCAGGAGAC |
| 5261 | 201 | UCCAGGAACCGUCAACUUAAA |
| 5262 | 202 | UAGACACAGAGGAAAGGCAGC |
| 5263 | 203 | AGCUCCGACACCAGGCGCCGG |
| 5264 | 204 | AAAUUUAUUCCUCCUGAAUGU |
| 5265 | 205 | ACCUCUGCUCUGCCGUCCCCU |
| 5266 | 206 | UUGCAAAGUGAACCUCAGAAC |
| 5267 | 207 | UGCAGCUCCUGGUCCUCGGCC |
| 5268 | 208 | CUGUAAAGUGAAAGGCUCCUG |
| 5269 | 209 | UGAAAGGCUCCUGUGAGGAGG |
| 5270 | 210 | AUGAUGACGAUAUCUUGAAAA |
| 5271 | 211 | AUCCUUUAAUGAGGAAGACUU |
| 5272 | 212 | AUUAUGGAAAUUUAUUCCUCC |
| 5273 | 213 | AAUGUAUAAGGCAGGAGACUA |
| 5274 | 214 | AGACUUGAAGCAAUGACAUCU |

TABLE 7-continued

Results for TRNP1. Score threshold: 70.
Design: siRNA 21 nt.

| SEQ ID NO | siRNA_id | siRNA guide strand/AS Sequence |
|---|---|---|
| 5275 | 215 | UAUAAGGCAGGAGACUAAUUC |
| 5276 | 216 | AGGUCAAUUCUCAACGUCUUC |
| 5277 | 217 | GAAUUCUACAAGUUCUGGGCU |
| 5278 | 218 | AGAAUUGGUCUGCAAAUCAAA |
| 5279 | 219 | CAAAGUGAACCUCAGAACCCC |
| 5280 | 220 | GAGAAUUGGUCUGCAAAUCAA |
| 5281 | 221 | AGGAACCGUCAACUUAAAGAG |
| 5282 | 222 | ACAGAGGAAAGGCAGCAAGGG |
| 5283 | 223 | CUGCAAAUCAAAGUCAACAGG |
| 5284 | 224 | UCAGGGACCUGUAGCAACAUC |
| 5285 | 225 | UCAUCACAUCCUUUAAUGAGG |
| 5286 | 226 | CAGACUAUCUUUCUGAGGGGC |
| 5287 | 227 | UUUGCCUUACAUUAUGGAAAU |
| 5288 | 228 | AGAAUUCUACAAGUUCUGGGC |
| 5289 | 229 | GAUCCUAGUCCUUCCAGCCG |
| 5290 | 230 | UACAUUCACUAUGCAGAAUUC |
| 5291 | 231 | AGCAGACUAUCUUUCUGAGGG |
| 5292 | 232 | CUGUGAGUCAGGUCAAGGGAG |
| 5293 | 233 | ACUGUAAAGUGAAAGGCUCCU |
| 5294 | 234 | GACUUGAAGCAAUGACAUCUA |
| 5295 | 235 | CACUUGCAAAGUGAACCUCAG |
| 5296 | 236 | CAGAUCCAUAGAGUGGAGGUU |
| 5297 | 237 | CUCAACGUCUUCCUGAAGGCA |
| 5298 | 238 | AGGUCCAGAUCCAUAGAGUGG |
| 5299 | 239 | GUCAUCACAUCCUUUAAUGAG |
| 5300 | 240 | AGCUCAGCCUCCUCUACUGGG |
| 5301 | 241 | AGAACAAGGGCAGUGGAUGAA |
| 5302 | 242 | GCAGACUAUCUUUCUGAGGGG |
| 5303 | 243 | UCAGCCUCCUCUACUGGGCCC |
| 5304 | 244 | CAUCUCCAAUUGUACAGUGUA |
| 5305 | 245 | CAGUCGGUCGGUCGGCACCUC |
| 5306 | 246 | GUAGGAGUCAAGGUCGGAGUU |
| 5307 | 247 | AAGGCAGCAAGGGCACUUGCA |
| 5308 | 248 | AAUAUACAUUCACUAUGCAGA |
| 5309 | 249 | UAGUCCUUCCAGCCGGCGUCC |
| 5310 | 250 | AGCAAGGGCACUUGCAAAGUG |
| 5311 | 251 | AAAGGCUCCUGUGAGGAGGGC |
| 5312 | 252 | UCUCCAGCUCCGACACCAGGC |
| 5313 | 253 | UCCUCGGCCGCGCCUGCUGAA |
| 5314 | 254 | GUAAAGUGAAAGGCUCCUGUG |
| 5315 | 255 | UGGUCCUCGGCCGCGCCUGCU |
| 5316 | 256 | UCUCAACGUCUUCCUGAAGGC |
| 5317 | 257 | UCCCUCCAUUAUCAGGAUGUU |
| 5318 | 258 | CAUUAUGGAAAUUUAUUCCUC |
| 5319 | 259 | AUAAGGCAGGAGACUAAUUCA |
| 5320 | 260 | UGCUACGCUUAAUCUGAUUGC |
| 5321 | 261 | ACAUCCUUUAAUGAGGAAGAC |
| 5322 | 262 | AAUUGGUCUGCAAAUCAAAGU |
| 5323 | 263 | GAUGACCACAGCACACCCGAA |
| 5324 | 264 | ACCUCCAGCAGCCGCCGCCGU |
| 5325 | 265 | CAAGGGAGAAUUGGUCUGCAA |
| 5326 | 266 | UGCGGCGGAAGGGCGAGUCGG |
| 5327 | 267 | AGUUCUCCAGAACCAGCCCCU |
| 5328 | 268 | UCAGGCUCUCCGCGCGGUGCG |
| 5329 | 269 | UGUAUAAGGCAGGAGACUAAU |
| 5330 | 270 | UGUGAGUCAGGUCAAGGGAGA |
| 5331 | 271 | CAACAUCUCCAAUUGUACAGU |
| 5332 | 272 | UCCUUCCAGCCGGCGUCCGCG |
| 5333 | 273 | AAGAAAUUCAGAGCAUCAGCC |
| 5334 | 274 | GACCACAGCACACCCGAACAG |
| 5335 | 275 | AAAGCCGAAUCCAGAGGUCCA |
| 5336 | 276 | UCUGAUUGCAUCUCAGGGACC |
| 5337 | 277 | GCAACAUCUCCAAUUGUACAG |
| 5338 | 278 | GUCAAUUCUCAACGUCUUCCU |
| 5339 | 279 | AGCUCCUGGUCCUCGGCCGCG |
| 5340 | 280 | ACAAGGGCAGUGGAUGAAGGG |
| 5341 | 281 | AAUGUUGUUUAAGAAUGAUGA |
| 5342 | 282 | AGGGACCUGUAGCAACAUCUC |
| 5343 | 283 | UGUAGGUGCGCAGGGAGGAUG |
| 5344 | 284 | GUUCUGAGGAGUUGGAAGGAG |
| 5345 | 285 | AUACAUUCACUAUGCAGAAUU |
| 5346 | 286 | ACACCCGAACAGCUAGACACG |
| 5347 | 287 | CUGAGGAGUUGGAAGGAGCUC |
| 5348 | 288 | AGACACAGAGGAAAGGCAGCA |

TABLE 7-continued

Results for TRNP1. Score threshold: 70.
Design: siRNA 21 nt.

| SEQ ID NO | siRNA_id | siRNA guide strand/AS Sequence |
|---|---|---|
| 5349 | 289 | AGUCAAGGUCGGAGUUGGGGG |
| 5350 | 290 | CUAAAUACAAGCUGCUCCAGG |
| 5351 | 291 | AGCGCUGCAGCUCCUGGUCCU |
| 5352 | 292 | UCCAGAGGUCCAGAUCCAUAG |
| 5353 | 293 | ACGUGGAGAACAAGGGCAGUG |
| 5354 | 294 | CAUCACAUCCUUUAAUGAGGA |
| 5355 | 295 | CGAAACUAAAUACAAGCUGCU |
| 5356 | 296 | AGUCCUUCCAGCCGGCGUCCG |
| 5357 | 297 | AAGUGAAAGGCUCCUGUGAGG |
| 5358 | 298 | AAGGAGCUCAGCCUCCUCUAC |
| 5359 | 299 | AGUGGAGGUUCUGAGGAGUUG |
| 5360 | 300 | GGACCUGUAGCAACAUCUCCA |
| 5361 | 301 | ACGCUUAAUCUGAUUGCAUCU |
| 5362 | 302 | CUCAGGGACCUGUAGCAACAU |
| 5363 | 303 | GGCACUUGCAAAGUGAACCUC |
| 5364 | 304 | CACCUCGGCGAAGCUUGUCGG |
| 5365 | 305 | AAGGCUCCUGUGAGGAGGGCG |
| 5366 | 306 | UCUACAAGUUCUGGGCUAUGU |
| 5367 | 307 | AGCUGCGUCCGGCAGCGGCGG |
| 5368 | 308 | AAGCUGCUCCAGGAACCGUCA |
| 5369 | 309 | AAUGCUUGCUACGCUUAAUCU |
| 5370 | 310 | CUUGCUACGCUUAAUCUGAUU |
| 5371 | 311 | AGGAAGACUUCCUGAGGAGGG |
| 5372 | 312 | CCAAUUGUACAGUGUAAGCCA |
| 5373 | 313 | CACUAUGCAGAAUUCUACAAG |
| 5374 | 314 | CUUGAAGCAAUGACAUCUAUU |
| 5375 | 315 | GUGGAGGUCAGCGCUGCGGGG |
| 5376 | 316 | AGCAACAUCUCCAAUUGUACA |
| 5377 | 317 | ACGAAACUAAAUACAAGCUGC |
| 5378 | 318 | AAGGGCGAGUCGGGCUCGGGG |
| 5379 | 319 | UAAGAGCAGGCGGCUGUGAGU |
| 5380 | 320 | UCCAGCAGCCGCCGCCGUGCU |
| 5381 | 321 | AAGGGCAGUGGAUGAAGGGAA |
| 5382 | 322 | AGUGGAUGAAGGGAACGGGGA |
| 5383 | 323 | CUGAUUGCAUCUCAGGGACCU |
| 5384 | 324 | AUUUGCCUUACAUUAUGGAAA |
| 5385 | 325 | AAACAGGCCUCCCGGCGCCGU |
| 5386 | 326 | UCAAACAGGCCUCCCGGCGCC |
| 5387 | 327 | AAGCACACUCCCACGUGGAGA |
| 5388 | 328 | AAGGGAGAAUUGGUCUGCAAA |
| 5389 | 329 | GAAUGAUGACGAUAUCUUGAA |

TABLE 8

Results for APLN. Score threshold: 70.
Design: siRNA 21 nt.

| SEQ ID NO | siRNA_id | siRNA guide strand/AS Sequence |
|---|---|---|
| 5390 | 1 | UUACAAACAUUGAACACAGGG |
| 5391 | 2 | UUUACAAACAUUGAACACAGG |
| 5392 | 3 | UUUCUUAAUGAACAGGGCCUU |
| 5393 | 4 | AUAUUUACACAGAACAAUCUU |
| 5394 | 5 | UAUUUACACAGAACAAUCUUU |
| 5395 | 6 | UAGUAUAAGAAUCAUAAACAA |
| 5396 | 7 | UAUAAAGACAUAUUUACACAG |
| 5397 | 8 | UACAAACAUUGAACACAGGGG |
| 5398 | 9 | UUCAUCAAGCAACUCUACUUU |
| 5399 | 10 | UAGGUCUCCAAAGUCAGUCCA |
| 5400 | 11 | UAUCUUUGUAUAAAUUAGUAU |
| 5401 | 12 | UUAUAUUGAACUCUUUGCAUU |
| 5402 | 13 | UUGACCUAGAACCGAUUUGGG |
| 5403 | 14 | AUAAGAAUCAUAAACAACCAC |
| 5404 | 15 | UCUUGUCUUCUCUUUCUCCCU |
| 5405 | 16 | UAACUAGAGUCUCUCCUUGCU |
| 5406 | 17 | UAUUAGAGUACCCUGGGUCUG |
| 5407 | 18 | UAUCAAAUGUAUUUAUUGCUG |
| 5408 | 19 | UCUUAACUAGAGUCUCUCCUU |
| 5409 | 20 | ACAAUCUUUACAAACAUUGAA |
| 5410 | 21 | UUCUUCAAAUGACACUGCCAA |
| 5411 | 22 | UAUAAGAAUCAUAAACAACCA |
| 5412 | 23 | AACUAGAGUCUCUCCUUGCUU |
| 5413 | 24 | AUGUUCUUAAAUAAACUGCUU |
| 5414 | 25 | UUUAAGCAGCAGCAGCAGCAG |
| 5415 | 26 | AACAGGACAGUUCACAGCCAG |
| 5416 | 27 | UUAUGGAACCUUCCAGCCCAG |

TABLE 8-continued

Results for APLN. Score threshold: 70.
Design: siRNA 21 nt.

| SEQ ID NO | siRNA_id | siRNA guide strand/AS Sequence |
|---|---|---|
| 5417 | 28 | UGGAGGAGACAUAACCGCCGG |
| 5418 | 29 | AAUCAUCCAAACUACAGCCAG |
| 5419 | 30 | UUUAUUAUAAAGCAUAUUUA |
| 5420 | 31 | AUAAAUUAGUAUAAGAAUCAU |
| 5421 | 32 | UAUAUUGAACUCUUUGCAUUU |
| 5422 | 33 | UUCUGUUCCUUUGCUUUCUUU |
| 5423 | 34 | UUAACUGAGCAAACGCUGAUG |
| 5424 | 35 | UACACAGAACAAUCUUUACAA |
| 5425 | 36 | UAAAGACAUAUUUACACAGAA |
| 5426 | 37 | ACAAACAUUGAACACAGGGGA |
| 5427 | 38 | UCUAACAUUCUGUGAUUCUUG |
| 5428 | 39 | UGAGCCUUUAAGCAGCAGCAG |
| 5429 | 40 | UUAUCAAAUGUAUUUAUUGCU |
| 5430 | 41 | UAUGUUCUUAAAUAAACUGCU |
| 5431 | 42 | UACAAACAAAGUCAUUAUCAA |
| 5432 | 43 | UAAAUUAGUAUAAGAAUCAUA |
| 5433 | 44 | UCAUCAAGCAACUCUACUUUG |
| 5434 | 45 | UGUUCUUAAAUAAACUGCUUU |
| 5435 | 46 | UUGAGCGGUAGUCUCAGUGCC |
| 5436 | 47 | UAAGUGACCUUCAAGGGUCCU |
| 5437 | 48 | UCUUCUGUUCCCUAUCUCCCA |
| 5438 | 49 | UUACACAGAACAAUCUUUACA |
| 5439 | 50 | UUAACUAGAGUCUCUCCUUGC |
| 5440 | 51 | UUCUCUUUCUCCCUCCUGGGA |
| 5441 | 52 | AACAAUUUCUUAAUGAACAGG |
| 5442 | 53 | UAUUGAACUCUUUGCAUUUUA |
| 5443 | 54 | UCAGCUCUAACAUUCUGUGAU |
| 5444 | 55 | AGAAUCAUAAACAACCACUUU |
| 5445 | 56 | UGACCUAGAACCGAUUUGGGA |
| 5446 | 57 | UUGUGAGAACGGGAAUCAU |
| 5447 | 58 | UUCCCUUCCUUCUUCUCCCCU |
| 5448 | 59 | UCAAGCAACUCUACUUUGUGA |
| 5449 | 60 | UUCCUGCUGCACUUCCUCCCA |
| 5450 | 61 | AUCUUUACAAACAUUGAACAC |
| 5451 | 62 | UUGGGAGGCACACUAAGGCAA |
| 5452 | 63 | UUGUAUAAAUUAGUAUAAGAA |
| 5453 | 64 | UUCCAGCCCAUUCCCAUCGGG |
| 5454 | 65 | UCUUUCUUUCCUUCCUUCUGU |
| 5455 | 66 | AUAGCAGAAGACACCCACCAA |
| 5456 | 67 | UCAGGCUCUUGUCUUCUCUUU |
| 5457 | 68 | UAAACAACCACUUUAAAUAAG |
| 5458 | 69 | UGUCAGCUCUAACAUUCUGUG |
| 5459 | 70 | UUCUUAAAUAAACUGCUUUAA |
| 5460 | 71 | UAAUAUCUUUGUAUAAAUUAG |
| 5461 | 72 | AUGGAGGAGACAUAACCGCCG |
| 5462 | 73 | UUAAGCAUAGGGAUUCAUUUU |
| 5463 | 74 | UUAAUAUCUUUGUAUAAAUUA |
| 5464 | 75 | AUAUUGAACUCUUUGCAUUUU |
| 5465 | 76 | UCUACCUCUCCCUUAACUGAG |
| 5466 | 77 | AUAUCUUUGUAUAAAUUAGUA |
| 5467 | 78 | AUCAAGCAACUCUACUUUGUG |
| 5468 | 79 | UCAAAUGUAUUUAUUGCUGAA |
| 5469 | 80 | UAGCAGAAGACACCCACCAAG |
| 5470 | 81 | UCCUGCUGCACUUCCUCCCAU |
| 5471 | 82 | UCUCCCAGCUUUCUUAGCCAU |
| 5472 | 83 | AAGAAUCAUAAACAACCACUU |
| 5473 | 84 | AUCUUUCUUUCCUUCCUUCUG |
| 5474 | 85 | AUUCUUGUGAGAACGGGAA |
| 5475 | 86 | AUUUACACAGAACAAUCUUUA |
| 5476 | 87 | AUUCUUCAAAUGACACUGCCA |
| 5477 | 88 | UUGUCUUCUCUUUCUCCCUCC |
| 5478 | 89 | UCAGGCUAUCUCAUUCAUCAA |
| 5479 | 90 | UUCUUAAUGAACAGGGCUUA |
| 5480 | 91 | UUAGAGUACCCUGGGUCUGGG |
| 5481 | 92 | UGGAGCUUGGGCUAGCUGGGG |
| 5482 | 93 | UAGAGUACCCUGGGUCUGGGA |
| 5483 | 94 | UGGACUGGACGGAUUCUUGUG |
| 5484 | 95 | UUGAAGGCUACCUCGGACUCC |
| 5485 | 96 | UCUGCAAUGACUCUGAGCAGG |
| 5486 | 97 | UCAAGGGUCCUGUCAGCUCUA |
| 5487 | 98 | UAAGCAUAGGGAUUCAUUUUG |
| 5488 | 99 | UUGCCUAAGAAGGCUAAGUGA |
| 5489 | 100 | UUUCCUUCCUUCUGUUCCUUU |
| 5490 | 101 | UGAGCGGUAGUCUCAGUGCCU |

TABLE 8-continued

Results for APLN. Score threshold: 70.
Design: siRNA 21 nt.

| SEQ ID NO | siRNA_id | siRNA guide strand/AS Sequence |
|---|---|---|
| 5491 | 102 | CUUAACUAGAGUCUCUCCUUG |
| 5492 | 103 | UUUACACAGAACAAUCUUUAC |
| 5493 | 104 | UAGUCUCAGUGCCUGAGCCGC |
| 5494 | 105 | UCUAUGGAGGAGACAUAACCG |
| 5495 | 106 | UUCAAGGGUCCUGUCAGCUCU |
| 5496 | 107 | UAUGGAGGAGACAUAACCGCC |
| 5497 | 108 | UGUGACCUGGUCAUUAAGCAU |
| 5498 | 109 | UUCUGCAGCCUCCUCUCCCGC |
| 5499 | 110 | UUUCUUUCCUUCCUUCUGUUC |
| 5500 | 111 | UAAGGGCGAACUGUCAGCUUU |
| 5501 | 112 | UGAGAGAACGGGAAUCAUCCA |
| 5502 | 113 | AUGCAGGCACUUACCUCCCUG |
| 5503 | 114 | UGACCCUCUGGGCUGCACCAG |
| 5504 | 115 | UCAUUCAUCAAGCAACUCUAC |
| 5505 | 116 | UAACUGUUUAUUAUAAAGACA |
| 5506 | 117 | AUUCAUCAAGCAACUCUACUU |
| 5507 | 118 | UUCCUUCUGUUCCUUUGCUUU |
| 5508 | 119 | AUCAAAUGUAUUUAUUGCUGA |
| 5509 | 120 | UAGAACCGAUUUGGGAUGCAG |
| 5510 | 121 | AAGUAGGAGAUGGGAGACCUG |
| 5511 | 122 | UAAGAAUCAUAAACAACCACU |
| 5512 | 123 | UAGCCCACCCACUACCCUCUU |
| 5513 | 124 | AUCAGGCUCUUGUCUUCUCUU |
| 5514 | 125 | UUUCCUCCGACCUCCCUGCCA |
| 5515 | 126 | UUGGGCAUCAGGCUCUUGUCU |
| 5516 | 127 | AACAAUCUUUACAAACAUUGA |
| 5517 | 128 | UCUUUACAAACAUUGAACACA |
| 5518 | 129 | UGUCUUCUCUUUCUCCCUCCU |
| 5519 | 130 | UCAUUAAGCAUAGGGAUUCAU |
| 5520 | 131 | UUAAUCAGUAUGUUCUUAAAU |
| 5521 | 132 | UACCUCUCCCUUAACUGAGCA |
| 5522 | 133 | AUUUCUUAAUGAACAGGGCCU |
| 5523 | 134 | UCCCUUAACUGAGCAAACGCU |
| 5524 | 135 | UUAAGCAGCAGCAGCAGCAGC |
| 5525 | 136 | UUAUAAAGACAUAUUUACACA |
| 5526 | 137 | UCUUUGUAUAAAUUAGUAUAA |
| 5527 | 138 | UGGGAUGCAGGCACUUACCU |
| 5528 | 139 | UGAGCAAACGCUGAUGCUCCA |
| 5529 | 140 | UAGAGUCUCUCCUUGCUUUUC |
| 5530 | 141 | AAGCAGCAGCAGCAGCAGCAG |
| 5531 | 142 | AGUGACAAAGGACUUCACGGG |
| 5532 | 143 | AAGAGAAGUGACAAAGGACUU |
| 5533 | 144 | UUCAUGCUGCUCCUUGGGCCG |
| 5534 | 145 | UGCUGCACUUCCUCCCAUCUU |
| 5535 | 146 | UCUCAUUCAUCAAGCAACUCU |
| 5536 | 147 | AUCUCAUUCAUCAAGCAACUC |
| 5537 | 148 | AAUUUCUUAAUGAACAGGGCC |
| 5538 | 149 | AGUAUGUUCUUAAAUAAACUG |
| 5539 | 150 | UAAGCAGCAGCAGCAGCAGCA |
| 5540 | 151 | AGACAUAUUACACAGAACAA |
| 5541 | 152 | UUAGAUGAGACAGGCAGGGAC |
| 5542 | 153 | UGAACAGGGCCUUAAUAUCUU |
| 5543 | 154 | AUAAAGACAUAUUUACACAGA |
| 5544 | 155 | ACACAGAACAAUCUUUACAAA |
| 5545 | 156 | UAGGACACCCAAACAGAUGCC |
| 5546 | 157 | UCCUCCCAUCUUUCUUUCCUU |
| 5547 | 158 | UAGGAGAUGGGAGACCUGGUC |
| 5548 | 159 | UGAACAUGACCUCCAAGAGUA |
| 5549 | 160 | UGCAAUGACUCUGAGCAGGUC |
| 5550 | 161 | UCUCCAAAGUCAGUCCAGGGA |
| 5551 | 162 | AGCAGCAGCAGCAGCAGCGUU |
| 5552 | 163 | UUCAGAAAGGCAUGGGUCCCU |
| 5553 | 164 | UCUUUCCUUCCUUCUGUUCCU |
| 5554 | 165 | AGUGAUUGAAGGCUACCUCGG |
| 5555 | 166 | AUUCCUUGACCCUCUGGGCUG |
| 5556 | 167 | UAAGGCAAGAGAAGUGACAAA |
| 5557 | 168 | UUCCUCCUUCCUUCUGCCCU |
| 5558 | 169 | UGGAACCUUCCAGCCCAGCUG |
| 5559 | 170 | AGAACAAUCUUUACAAACAUU |
| 5560 | 171 | UCUUCUCUUUCUCCCUCCUGG |
| 5561 | 172 | UUCCUUCCUUCUGUUCCUUUG |
| 5562 | 173 | UUUAUUAAAGACAUAUUUAC |
| 5563 | 174 | UCUACUUUGUGAAACAUAAAA |
| 5564 | 175 | UGCACGUGCAAUAUGUGGGCA |

TABLE 8-continued

Results for APLN. Score threshold: 70.
Design: siRNA 21 nt.

| SEQ ID NO | siRNA_id | siRNA guide strand/AS Sequence |
|---|---|---|
| 5565 | 176 | UUCCUCCCAUCUUUCUUUCCU |
| 5566 | 177 | AACUCUACUUUGUGAAACAUA |
| 5567 | 178 | UUCUUGUGAGAGAACGGGAAU |
| 5568 | 179 | UCUCUGCAUUCUUCCCUGGAG |
| 5569 | 180 | ACAAUUUCUUAAUGAACAGGG |
| 5570 | 181 | AUAAACAACCACUUUAAAUAA |
| 5571 | 182 | AGGUCUCCAAAGUCAGUCCAG |
| 5572 | 183 | AGAAGCAGACCAAUCUAUGGA |
| 5573 | 184 | AACAAAGUCAUUAUCAAAUGU |
| 5574 | 185 | AUGCUCCACCCACUUCACCAG |
| 5575 | 186 | AAUCAUAAACAACCACUUUAA |
| 5576 | 187 | UGAUUGAAGGCUACCUCGGAC |
| 5577 | 188 | UAAGAAGGCUAAGUGACCUUC |
| 5578 | 189 | CAGAACAAUCUUUACAAACAU |
| 5579 | 190 | AACUGAGCAAACGCUGAUGCU |
| 5580 | 191 | CUCUUAACUAGAGUCUCUCCU |
| 5581 | 192 | ACAACCACUUUAAAUAAGGCA |
| 5582 | 193 | UAUAAAUUAGUAUAAGAAUCA |
| 5583 | 194 | UUUCUCCCUCCUGGGAACCCU |
| 5584 | 195 | UCUCUUUCUCCCUCCUGGGAA |
| 5585 | 196 | UUUGCCUAAGAAGGCUAAGUG |
| 5586 | 197 | UAUUCCUGCUGCACUUCCUCC |
| 5587 | 198 | ACUAGAGUCUCUCCUUGCUUU |
| 5588 | 199 | AAGAAGGGAGGCUUUCUGGGG |
| 5589 | 200 | AUUGGGAGGCACACUAAGGCA |
| 5590 | 201 | UUCUCCCUCCUGGGAACCCUG |
| 5591 | 202 | UGGGUCUGGGAAUGCUGCCAG |
| 5592 | 203 | UCAGGGACCUCCACACACCG |
| 5593 | 204 | UGAGUGUGCGCGCUGAGCCCC |
| 5594 | 205 | AAGUGACAAAGGACUUCACGG |
| 5595 | 206 | AAUAUCUUUGUAUAAAUUAGU |
| 5596 | 207 | CUCUGCAAUGACUCUGAGCAG |
| 5597 | 208 | CUUUCCUUCCUUCUGUUCCUU |
| 5598 | 209 | AGAUUCAUGCUGCUCCUUGGG |
| 5599 | 210 | CAACAGGACAGUUCACAGCCA |
| 5600 | 211 | UUAGCAGCAGCAUAGGUAAAG |
| 5601 | 212 | AACUGUUUAUUAUAAAGACAU |
| 5602 | 213 | AAGUGACCUUCAAGGGUCCUG |
| 5603 | 214 | UUCCUCCGACCUCCCUGCCAG |
| 5604 | 215 | GUCUUCUCUUUCUCCCUCCUG |
| 5605 | 216 | CUUAACGAGCAAACGCUGAU |
| 5606 | 217 | UAUUAUAAAGACAUAUUUACA |
| 5607 | 218 | AUUCCCAUCGGGAAGCGGCAU |
| 5608 | 219 | AUCAUAAACAACCACUUUAAA |
| 5609 | 220 | UAUGGGAGGCACACUAAGGC |
| 5610 | 221 | AAGGCUACCUCGGACUCCUGA |
| 5611 | 222 | GUGAUUGAAGGCUACCUCGGA |
| 5612 | 223 | UCCCAUCUUUCUUUCCUUCCU |
| 5613 | 224 | UCAUAAAGUAGGAGAUGGGAG |
| 5614 | 225 | ACAAAGUCAUUAUCAAAUGUA |
| 5615 | 226 | UGACCUUCAAGGGUCCUGUCA |
| 5616 | 227 | AAAGUUGGGCAUCAGGCUCUU |
| 5617 | 228 | ACUCUGAGCAGGUCACUCCCC |
| 5618 | 229 | AUCUUUGUAUAAAUUAGUAUA |
| 5619 | 230 | UGAUACAAACAAAGUCAUUAU |
| 5620 | 231 | CUUCCUUCUGUUCCUUUGCUU |
| 5621 | 232 | UCCUGGGAGGGUAUAUAGCCA |
| 5622 | 233 | CAACUCUACUUUGUGAAACAU |
| 5623 | 234 | UUUGUAUAAAUUAGUAUAAGA |
| 5624 | 235 | CUUGUCUUCUCUUUCUCCCUC |
| 5625 | 236 | UGGGAUGCAGGCACUUACCUC |
| 5626 | 237 | UCUUCUGCAGCCUCCUCUCCC |
| 5627 | 238 | AUGACCUCCAAGAGUAAGGGC |
| 5628 | 239 | AAUUAGUAUAAGAAUCAUAAA |
| 5629 | 240 | UGGGCAUCAGGCUCUUGUCUU |
| 5630 | 241 | UCUCUACCUCUCCCUUAACUG |
| 5631 | 242 | AUUAUAAAGACAUAUUUACAC |
| 5632 | 243 | UAACUGAGCAAACGCUGAUGC |
| 5633 | 244 | UCAUCAAGAGGGAAGAGGGCG |
| 5634 | 245 | UCUGUUCCUUUGCUUUCUUUU |
| 5635 | 246 | AUCUCCCAGCUUUCUUAGCCA |
| 5636 | 247 | UGCUGGAGCCCACAGAAGGGA |
| 5637 | 248 | UUCUGGGCACCGACCAGUCCC |
| 5638 | 249 | UGGAUAGGCAAACAUUGGGGC |

TABLE 8-continued

Results for APLN. Score threshold: 70.
Design: siRNA 21 nt.

| SEQ ID NO | siRNA_id | siRNA guide strand/AS Sequence |
|---|---|---|
| 5639 | 250 | UCCGCUCUUCUGCAGCCUCCU |
| 5640 | 251 | UGACCUCCAAGAGUAAGGGCG |
| 5641 | 252 | UAGGUCAGGGAGGUGGGAGCA |
| 5642 | 253 | AAGUUGGGCAUCAGGCUCUUG |
| 5643 | 254 | AUUAGGACACCCAAACAGAUG |
| 5644 | 255 | UUUAAUCAGUAUGUUCUUAAA |
| 5645 | 256 | UUAAUGAACAGGGCCUUAAUA |
| 5646 | 257 | GUCAGCUCUAACAUUCUGUGA |
| 5647 | 258 | CCUGUCAGCUCUAACAUUCUG |
| 5648 | 259 | ACCUCUUAACUAGAGUCUCUC |
| 5649 | 260 | UCAACACGAAGGGAAGGCCAU |
| 5650 | 261 | CUAUGGAGGAGACAUAACCGC |
| 5651 | 262 | UCCAAGAGUAAGGGCGAACUG |
| 5652 | 263 | CUUCUGUUCCCUAUCUCCCAG |
| 5653 | 264 | AAUGACUCUGAGCAGGUCACU |
| 5654 | 265 | ACAAACAAAGUCAUUAUCAAA |
| 5655 | 266 | AUUCCUGCUGCACUUCCUCCC |
| 5656 | 267 | ACCGCGGUCAAGGAGAGCCAG |
| 5657 | 268 | GAAUCAUCCAAACUACAGCCA |
| 5658 | 269 | UACAGCAGGUGCGAGGUGAGA |
| 5659 | 270 | AGGAAGGUCCGGUCAACACGA |
| 5660 | 271 | AUGAUACAAACAAAGUCAUUA |
| 5661 | 272 | CUUUACAAACAUUGAACACAG |
| 5662 | 273 | UCAUGCUGCUCCUUGGGCCGC |
| 5663 | 274 | AGCCCUGGAAGGAAGGUCCGG |
| 5664 | 275 | UGAGAGCUGAAUGGACGUGAG |
| 5665 | 276 | UUAAAUAAACUGCUUUAAAAA |
| 5666 | 277 | ACAUUGCCGUCUUCCAGCCCA |
| 5667 | 278 | AAUCUUUACAAACAUUGAACA |
| 5668 | 279 | AUGACUCUGAGCAGGUCACUC |
| 5669 | 280 | AUUAGAGUACCCUGGGUCUGG |
| 5670 | 281 | AAACGCUGAUGCUCCACCCAC |
| 5671 | 282 | AAGCAGACCAAUCUAUGGAGG |
| 5672 | 283 | UCCUUCCUUCUGCCCUUCCCU |
| 5673 | 284 | CUUUCUUCCUUCCUUCUGUU |
| 5674 | 285 | UUGACCCUCUGGGCUGCACCA |
| 5675 | 286 | UUCCUUGACCCUCUGGGCUGC |

TABLE 8-continued

Results for APLN. Score threshold: 70.
Design: siRNA 21 nt.

| SEQ ID NO | siRNA_id | siRNA guide strand/AS Sequence |
|---|---|---|
| 5676 | 287 | AACAGGGCCUUAAUAUCUUUG |
| 5677 | 288 | UUCCCUAUCUCCCAGCUUUCU |
| 5678 | 289 | AUCAUCAAGAGGGAAGAGGGC |
| 5679 | 290 | AUCGGGAAGCGGCAUCAGGGA |
| 5680 | 291 | UGAAUGGACGUGAGGCCUCCA |
| 5681 | 292 | CAUUUAAUCAGUAUGUUCUUA |
| 5682 | 293 | AAGAGACUUUCUGGGCACCGA |
| 5683 | 294 | UGAGACAGGCAGGGACUAGGG |
| 5684 | 295 | AUGGACUGGACGGAUUCUUGU |
| 5685 | 296 | AGAAGGCUAAGUGACCUUCAA |
| 5686 | 297 | AAAGUCAUUAUCAAAUGUAUU |
| 5687 | 298 | UGACCUGGUCAUUAAGCAUAG |
| 5688 | 299 | AGCGUUAGCAGCAGCAUAGGU |
| 5689 | 300 | UAGUAGCGAUCCUGCAUUUAA |
| 5690 | 301 | GAACAAUUUCUUAAUGAACAG |
| 5691 | 302 | AACAUGACCUCCAAGAGUAAG |
| 5692 | 303 | UGAAGGCUACCUCGGACUCCU |
| 5693 | 304 | CUGUCAGCUCUAACAUUCUGU |
| 5694 | 305 | UGUAUAAAUUAGUAUAAGAAU |
| 5695 | 306 | ACACACAAAGUUGGGCAUCAG |
| 5696 | 307 | GAGAGAACGGGAAUCAUCCAA |
| 5697 | 308 | UCCAGUGAUUGAAGGCUACCU |
| 5698 | 309 | UAUCUCAUUCAUCAAGCAACU |
| 5699 | 310 | AGAGUAAGGGCGAACUGUCAG |
| 5700 | 311 | UCCCUCCUUCCUUCUGCCCUU |
| 5701 | 312 | UCCUGCUUCAGAAAGGCAUGG |
| 5702 | 313 | UUUCGGGCACCGACCAGUCC |
| 5703 | 314 | AGGCACUUCAUUUGCUUUGAA |
| 5704 | 315 | UCUGCCCUUCCCUUCCUUCUU |
| 5705 | 316 | CUAACAUUCUGUGAUUCUUGG |
| 5706 | 317 | UAUCUCCCAGCUUUCUUAGCC |
| 5707 | 318 | CAAGCAACUCUACUUUGUGAA |
| 5708 | 319 | AACCGAUUUGGGAUGCAGGCA |
| 5709 | 320 | AUACAAACAAAGUCAUUAUCA |
| 5710 | 321 | UCCUUCUGCCCUUCCCUUCCU |
| 5711 | 322 | ACAUGAGGAAGGAAGGCCCAA |
| 5712 | 323 | GAAGGGAGCACUUCCACCCCG |

TABLE 8-continued

Results for APLN. Score threshold: 70.
Design: siRNA 21 nt.

| SEQ ID NO | siRNA_id | siRNA guide strand/AS Sequence |
|---|---|---|
| 5713 | 324 | GUAGUCUCAGUGCCUGAGCCG |
| 5714 | 325 | UCCUGUCAGCUCUAACAUUCU |
| 5715 | 326 | UCCCUAUCUCCCAGCUUUCUU |
| 5716 | 327 | CUAAGAAGGCUAAGUGACCUU |
| 5717 | 328 | AGGACACCCAAACAGAUGCCA |
| 5718 | 329 | AAUCAGUAUGUUCUUAAAUAA |
| 5719 | 330 | AGUUGACCUAGAACCGAUUUG |
| 5720 | 331 | CAAACGCUGAUGCUCCACCCA |
| 5721 | 332 | AGCAGCAGCAUAGGUAAAGGG |
| 5722 | 333 | AACCUUCCAGCCCAGCUGGGG |
| 5723 | 334 | CUGGUCAUUAAGCAUAGGGAU |
| 5724 | 335 | UCAUAAACAACCACUUUAAAU |
| 5725 | 336 | AGAGAAGUGACAAAGGACUUC |
| 5726 | 337 | CAGAGCCGCAGAUUCAUGCUG |
| 5727 | 338 | AAGGGAACAAUUUCUUAAUGA |
| 5728 | 339 | CUAGAGUCUCUCCUUGCUUUU |
| 5729 | 340 | UCAGAAAGGCAUGGGUCCCUU |
| 5730 | 341 | UAGCGAUCCUGCAUUUAAUCA |
| 5731 | 342 | UUCUGUUCCCUAUCUCCCAGC |
| 5732 | 343 | UGGAGUCCAGUGAUUGAAGGC |
| 5733 | 344 | AGUCAUUAUCAAAUGUAUUUA |
| 5734 | 345 | GAAUCAUAAACAACCACUUUA |
| 5735 | 346 | AGGUCCGGUCAACACGAAGGG |
| 5736 | 347 | AGUUAUGGAACCUUCCAGCCC |
| 5737 | 348 | GAGAGGGUGCUAUUCCUGCUG |
| 5738 | 349 | AGGAAGAAGGGAGUAUUGGGA |
| 5739 | 350 | CUCUAACAUUCUGUGAUUCUU |
| 5740 | 351 | AGAAGUGACAAAGGACUUCAC |
| 5741 | 352 | UCAGGGAGGUGGGAGCAGCUC |
| 5742 | 353 | AGGAGACACAGAAAGGAAGGG |
| 5743 | 354 | UGCACUUCCUCCCAUCUUUCU |
| 5744 | 355 | AUUGAAGGCUACCUCGGACUC |
| 5745 | 356 | AGAAGGGAGCACUUCCACCCC |
| 5746 | 357 | UCCCUUAUGGGAGAGGCGGGG |
| 5747 | 358 | UGACAAAGGACUUCACGGGCC |
| 5748 | 359 | UGCAAUAUGUGGGCAUGGGGA |
| 5749 | 360 | ACAGGCAGGGACUAGGGCGGA |
| 5750 | 361 | ACUGAGCAAACGCUGAUGCUC |
| 5751 | 362 | UGCGAGGUGAGAGCUGAAUGG |
| 5752 | 363 | ACCUCUCCCUUAACUGAGCAA |
| 5753 | 364 | UGCUCCACCCACUUCACCAGA |
| 5754 | 365 | CUUCUGUUCCUUUGCUUUCUU |
| 5755 | 366 | UCAUUAUCAAAUGUAUUUAUU |
| 5756 | 367 | UGACUCUGAGCAGGUCACUCC |
| 5757 | 368 | AAGGAAGGUCCGGUCAACACG |
| 5758 | 369 | AGUAGGAGAUGGGAGACCUGG |
| 5759 | 370 | UGGUCAUUAAGCAUAGGGAUU |
| 5760 | 371 | GAGCGGUAGUCUCAGUGCCUG |
| 5761 | 372 | UAAUGAACAGGGCCUUAAUAU |
| 5762 | 373 | UCCCUGCACGUGCAAUAUGUG |
| 5763 | 374 | AGCACCUCUUAACUAGAGUCU |
| 5764 | 375 | ACAAAGUGGGCAUCAGGCUC |
| 5765 | 376 | CAGAGAAGCAGACCAAUCUAU |
| 5766 | 377 | AUGGACGUGAGGCCUCCAGAG |
| 5767 | 378 | AUCAGUAUGUUCUUAAAUAAA |
| 5768 | 379 | AGCGAUCCUGCAUUUAAUCAG |
| 5769 | 380 | UGAGGCAGGAGACACAGAAAG |
| 5770 | 381 | AAGAGUAAGGGCGAACUGUCA |
| 5771 | 382 | UUGCCUCUCCCUUCCCUUCCC |
| 5772 | 383 | CUUCUCUUUCUCCCUCCUGGG |
| 5773 | 384 | CUCAUUCAUCAAGCAACUCUA |
| 5774 | 385 | AGGCAGGAGACACAGAAGGA |
| 5775 | 386 | UUAGUAUAAGAAUCAUAAACA |
| 5776 | 387 | UUACCUCCCUGCACGUGCAAU |
| 5777 | 388 | AAGCAACUCUACUUUGUGAAA |
| 5778 | 389 | ACCUCCAAGAGUAAGGGCGAA |
| 5779 | 390 | UAAUCAGUAUGUUCUUAAAUA |
| 5780 | 391 | AGUCCUGCUUCAGAAAGGCAU |
| 5781 | 392 | AGGCAGGUGAGAGAGCUGGG |
| 5782 | 393 | GUGGAUAGGCAAACAUUGGGG |
| 5783 | 394 | GGAUUCUUGUGAGAGAACGGG |
| 5784 | 395 | UCUCAGUGCCUGAGCCGCCCC |
| 5785 | 396 | ACUGUUUAUUAUAAAGACAUA |
| 5786 | 397 | UCCUGCAUUUAAUCAGUAUGU |

TABLE 8-continued

Results for APLN. Score threshold: 70.
Design: siRNA 21 nt.

| SEQ ID NO | siRNA_id | siRNA guide strand/AS Sequence |
|---|---|---|
| 5787 | 398 | UUCAGUCCUGCUUCAGAAAGG |
| 5788 | 399 | AUUUAAUCAGUAUGUUCUUAA |
| 5789 | 400 | AUUAGUAUAAGAAUCAUAAAC |
| 5790 | 401 | AUAAAGUAGGAGAUGGGAGAC |
| 5791 | 402 | CAAGCAUGAGCCUUUAAGCAG |
| 5792 | 403 | GACAUAUUUACACAGAACAAU |
| 5793 | 404 | UAGAUGAGACAGGCAGGGACU |
| 5794 | 405 | UGUUCCCUAUCUCCCAGCUUU |
| 5795 | 406 | AGCAGGAGCGCCUGCACGCAG |
| 5796 | 407 | UUAGGACACCCAAACAGAUGC |
| 5797 | 408 | UCUUAAAUAAACUGCUUUAAA |
| 5798 | 409 | UCCUUCUGUUCCUUUGCUUUC |
| 5799 | 410 | CCCAUCUUUCUUUCCUUCCUU |
| 5800 | 411 | AAGUCAUUAUCAAAUGUAUUU |
| 5801 | 412 | UUCUUUCCUUCCUUCUGUUCC |
| 5802 | 413 | AUGGAGUCCAGUGAUUGAAGG |
| 5803 | 414 | ACGGAAGCUAGGGCCUCCCGG |
| 5804 | 415 | UACCCUGGGUCUGGGAAUGCU |
| 5805 | 416 | ACAAGGGAUCUGCUGGAGCCC |
| 5806 | 417 | AGAUGGACUGGACGGAUUCUU |
| 5807 | 418 | AUCAAGAGGGAAGAGGGCGUC |
| 5808 | 419 | ACCUGGAGCUUGGGCUAGCUG |
| 5809 | 420 | UCUUAUGAACAGGGCCUUAA |
| 5810 | 421 | GAUUCUUGUGAGAGAACGGGA |
| 5811 | 422 | AUUGCCGUCUUCCAGCCCAUU |
| 5812 | 423 | AUUAUCAAAUGUAUUUAUUGC |
| 5813 | 424 | AGACAGGCAGGGACUAGGGCG |
| 5814 | 425 | UGCAUUUAAUCAGUAUGUUCU |
| 5815 | 426 | CGCAGAUUCAUGCUGCUCCUU |
| 5816 | 427 | AUUAAGCAUAGGGAUUCAUUU |
| 5817 | 428 | AUUCAUGCUGCUCCUUGGGCC |
| 5818 | 429 | CACCUCUUAACUAGAGUCUCU |
| 5819 | 430 | AACAACCACUUUAAAUAAGGC |
| 5820 | 431 | UCCAAAGUCAGUCCAGGGAGG |
| 5821 | 432 | AGAUGAGACAGGCAGGGACUA |
| 5822 | 433 | GCUAUCUCAUUCAUCAAGCAA |
| 5823 | 434 | AACGGGAAUCAUCCAAACUAC |
| 5824 | 435 | ACUACCCUCUUCUGUUCCCUA |
| 5825 | 436 | AAGAAGGCUAAGUGACCUUCA |
| 5826 | 437 | UCUGUUCCCUAUCUCCCAGCU |
| 5827 | 438 | AGGUGAGAGCUGAAUGGACGU |
| 5828 | 439 | AGGGACCCUCCACACACCGCG |
| 5829 | 440 | CUGAACAUGACCUCCAAGAGU |
| 5830 | 441 | AGUAUUGGGAGGCACACUAAG |
| 5831 | 442 | AGGCUCUUGUCUUCUCUUUCU |
| 5832 | 443 | UGCAUUCUUCCCUGGAGGCCA |
| 5833 | 444 | CACUUCACCAGAGCUCCUGAA |
| 5834 | 445 | CAUCAGGCUCUUGUCUUCUCU |
| 5835 | 446 | GUUAUGGAACCUUCCAGCCCA |
| 5836 | 447 | CAGCAGCAGCAGCAGCAGCAG |
| 5837 | 448 | CUUACCUCCCUGCACGUGCAA |
| 5838 | 449 | GGAGGAGACAUAACCGCCGGG |
| 5839 | 450 | GUAAGGGCGAACUGUCAGCUU |
| 5840 | 451 | CUGACCUGGAGCUUGGGCUAG |
| 5841 | 452 | AGGUGGAUAGGCAAACAUUGG |
| 5842 | 453 | CUCUUGUCUUCUCUUUCUCCC |
| 5843 | 454 | CAUAUUUACACAGAACAAUCU |
| 5844 | 455 | AAGGGCGAACUGUCAGCUUUU |
| 5845 | 456 | AGACUUUCUGGGCACCGACCA |
| 5846 | 457 | AAACAAAGUCAUUAUCAAAUG |
| 5847 | 458 | ACACUAAGGCAAGAGAAGUGA |
| 5848 | 459 | UCCUUGACCCUCUGGGCUGCA |
| 5849 | 460 | CAAUUUCUUAUGAACAGGGC |
| 5850 | 461 | CAUCAAGCAACUCUACUUUGU |
| 5851 | 462 | AGAAGAAGGGAGGCUUUCUGG |
| 5852 | 463 | CAGCAGCAGCAGCAGCAGCGU |
| 5853 | 464 | GAACAAUCUUUACAAACAUUG |
| 5854 | 465 | AGGCUAAGUGACCUUCAAGGG |
| 5855 | 466 | UCGGGAAGCGGCAUCAGGGAC |
| 5856 | 467 | UAGCAGCAGCAUAGGUAAAGG |
| 5857 | 468 | AAGGCAUGGGUCCCUUAUGGG |
| 5858 | 469 | UCUGCAGCCUCCUCUCCCGCC |
| 5859 | 470 | GAAGCAGACCAAUCUAUGGAG |
| 5860 | 471 | AUGAGCCUUUAAGCAGCAGCA |

TABLE 8-continued

Results for APLN. Score threshold: 70.
Design: siRNA 21 nt.

| SEQ ID NO | siRNA_id | siRNA guide strand/AS Sequence |
|---|---|---|
| 5861 | 472 | AGCUGAAUGGACGUGAGGCCU |
| 5862 | 473 | GAAGGCUACCUCGGACUCCUG |
| 5863 | 474 | CUGUUCCCUAUCUCCCAGCUU |
| 5864 | 475 | AGCUCUAACAUUCUGUGAUUC |
| 5865 | 476 | AGCAGCGUUAGCAGCAGCAUA |
| 5866 | 477 | UCUGGGCACCGACCAGUCCCC |
| 5867 | 478 | AGGAAGAUGGACUGGACGGAU |
| 5868 | 479 | ACCUGGUCAUUAAGCAUAGGG |
| 5869 | 480 | GAUGCAGGCACUUACCUCCCU |
| 5870 | 481 | AUCUGCUGGAGCCCACAGAAG |
| 5871 | 482 | CUAUUCCUGCUGCACUUCCUC |
| 5872 | 483 | AUCCUGCAUUUAAUCAGUAUG |
| 5873 | 484 | CAGAAGACACCCACCAAGGAU |
| 5874 | 485 | ACAACAGGACAGUUCACAGCC |
| 5875 | 486 | UGCAGCCUCCUCUCCCGCCGC |
| 5876 | 487 | UCAGUCCUGCUUCAGAAAGGC |
| 5877 | 488 | ACGCUGAUGCUCCACCCACUU |
| 5878 | 489 | CAGCAGCAGCGUUAGCAGCAG |
| 5879 | 490 | GAACCUUCCAGCCCAGCUGGG |
| 5880 | 491 | UAUGGAACCUUCCAGCCCAGC |
| 5881 | 492 | AAAUUAGUAUAAGAAUCAUAA |
| 5882 | 493 | CUCCUGAACAUGACCUCCAAG |
| 5883 | 494 | UCCUGACCUGGAGCUUGGGCU |
| 5884 | 495 | CUGUUUAUUAUAAAGACAUAU |
| 5885 | 496 | GCGGACAUUGCCGUCUUCCAG |
| 5886 | 497 | CUCUGAGCAGGUCACUCCCCU |
| 5887 | 498 | CACACACACAAAGUUGGGCAU |
| 5888 | 499 | CCAGAGAAGCAGACCAAUCUA |
| 5889 | 500 | AUGUGACCUGGUCAUUAAGCA |
| 5890 | 501 | AGGAAGGCCCAAAUGAAGGUU |
| 5891 | 502 | UCUCCCUUAACUGAGCAAACG |
| 5892 | 503 | AGCGGUAGUCUCAGUGCCUGA |
| 5893 | 504 | UCUGCAUUCUUCCCUGGAGGC |
| 5894 | 505 | UCCACCCACUUCACCAGAGCU |
| 5895 | 506 | UACUCCUGGGAGGGUAUAUAG |
| 5896 | 507 | CAGUGAUUGAAGGCUACCUCG |
| 5897 | 508 | GACUUUCUGGGCACCGACCAG |
| 5898 | 509 | CUUUGUAUAAAUUAGUAUAAG |
| 5899 | 510 | AUGAACAGGGCCUUAAUAUCU |
| 5900 | 511 | ACCCACUUCACCAGAGCUCCU |
| 5901 | 512 | CUUCUGCAGCCUCCUCUCCCG |
| 5902 | 513 | AAGAUGGACUGGACGGAUUCU |
| 5903 | 514 | UGUGCCCUGUCUGGAUCCCCG |
| 5904 | 515 | AGGCACACUAAGGCAAGAGAA |
| 5905 | 516 | AGUAUAAGAAUCAUAAACAAC |
| 5906 | 517 | UGCGGGCGCAGAGCUCGGGAG |
| 5907 | 518 | AUGUGCCCUGUCUGGAUCCCC |
| 5908 | 519 | AAGAGCUGGGCCCACUGGUGG |
| 5909 | 520 | AGCGCCUGCACGCAGAGCCGC |
| 5910 | 521 | UAAAGUAGGAGAUGGGAGACC |
| 5911 | 522 | AUUUCCUCCGACCUCCCUGCC |
| 5912 | 523 | GACAUUGCCGUCUUCCAGCCC |
| 5913 | 524 | AAAGAAGGCCCAAUCCCUGAU |
| 5914 | 525 | AUGCUGCUCCUUGGGCCGCCG |
| 5915 | 526 | AGGAGACAUAACCGCCGGGGG |
| 5916 | 527 | AAGACAUAUUUACACAGAACA |
| 5917 | 528 | UCCGGGAGCGGCAGCGGCGAG |
| 5918 | 529 | AGAUGGGAGACCUGGUCCCCA |
| 5919 | 530 | UGCCUCUCCCUUCCCUUCCCC |
| 5920 | 531 | AAGAAGGGAGUAUUGGGAGGC |
| 5921 | 532 | CUGGAAGGAAGGUCCGGUCAA |
| 5922 | 533 | GAACAGGGCCUUAAUAUCUUU |
| 5923 | 534 | CCCACUUCACCAGAGCUCCUG |
| 5924 | 535 | AAAGACAUAUUUACACAGAAC |
| 5925 | 536 | GAAUUCCUCCGACCUCCCUG |
| 5926 | 537 | UGGACGGAUUCUUGUGAGAGA |
| 5927 | 538 | AGGGCAGACAUGAGGAAGGAA |
| 5928 | 539 | GAGGAGACAUAACCGCCGGGG |
| 5929 | 540 | UGCUUCAGAAAGGCAUGGGUC |
| 5930 | 541 | CAAGGGUCCUGUCAGCUCUAA |
| 5931 | 542 | UCUUGUGAGAACGGGAAUC |
| 5932 | 543 | AGCAGACCAAUCUAUGGAGGA |
| 5933 | 544 | GAGUCCAGUGAUUGAAGGCUA |
| 5934 | 545 | AGGUGAGAAGAGCUGGGCCCA |

TABLE 8-continued

Results for APLN. Score threshold: 70. Design: siRNA 21 nt.

| SEQ ID NO | siRNA_id | siRNA guide strand/AS Sequence |
|---|---|---|
| 5935 | 546 | UCCAGCCCAUUCCCAUCGGGA |
| 5936 | 547 | AGGCGUUUGCCUAAGAAGGCU |
| 5937 | 548 | CCCUUAACUGAGCAAACGCUG |
| 5938 | 549 | CGGCUCUGCAAUGACUCUGAG |
| 5939 | 550 | AGGGAACAAUUUCUUAAUGAA |
| 5940 | 551 | UCCCGGCUCUGCAAUGACUCU |
| 5941 | 552 | CUGGGAACCCUGCUCAAGCAA |
| 5942 | 553 | AGGGCCUUAAUAUCUUUGUAU |
| 5943 | 554 | AGCAUGAGCCUUUAAGCAGCA |
| 5944 | 555 | UGAGAAGAGCUGGGCCCACUG |
| 5945 | 556 | AGUAAGGGCGAACUGUCAGCU |
| 5946 | 557 | AACCACUUUAAAUAAGGCAGC |
| 5947 | 558 | AGGUCAGGGAGGUGGGAGCAG |
| 5948 | 559 | UGCCUAAGAAGGCUAAGUGAC |
| 5949 | 560 | CCACACACCGCGGUCAAGGAG |
| 5950 | 561 | CAGCUCUAACAUUCUGUGAUU |
| 5951 | 562 | UGGGAGGCACACUAAGGCAAG |
| 5952 | 563 | GGUGAGAGCUGAAUGGACGUG |
| 5953 | 564 | GAGGGCGUCAUAAAGUAGGAG |
| 5954 | 565 | AGCUUGCCUCUCCCUUCCCUU |
| 5955 | 566 | UCUUCCCUCCUUCCUUCUGCC |
| 5956 | 567 | AGAAGAGCUGGGCCCACUGGU |
| 5957 | 568 | GGAAGGUCCGGUCAACACGAA |
| 5958 | 569 | CAUUCCUUGACCCUCUGGGCU |
| 5959 | 570 | AUGAGGCAGGAGACACAGAAA |
| 5960 | 571 | GCAUUUAAUCAGUAUGUUCUU |
| 5961 | 572 | CUUCCCUUCCUUCUUCUCCCC |
| 5962 | 573 | CACUACCCUCUUCUGUUCCCU |
| 5963 | 574 | GACAUGAGGAAGGAAGGCCCA |
| 5964 | 575 | UGAUGCUCCACCCACUUCACC |
| 5965 | 576 | AAAGUAGGAGAUGGGAGACCU |
| 5966 | 577 | CACAGAAGGGAGCACUUCCAC |

TABLE 9

Results for KIF20A. Score threshold: 70. Design: siRNA 21 nt.

| SEQ ID NO | siRNA_id | AS Sequence |
|---|---|---|
| 5967 | 1 | UAAUUUAGCUUUAACCUCCUG |
| 5968 | 2 | UUCACAUUGACAAUCAUGCAG |
| 5969 | 3 | UUUGAGUACAUCCUUUACCAU |
| 5970 | 4 | UUCUUGUCCACAUCAAUGGUG |
| 5971 | 5 | UUGACAAUCAUGCAGGAACGG |
| 5972 | 6 | UAGCUCUGCUUUGCACUGCUG |
| 5973 | 7 | UAGGUCAUAAAGCAGUUCGUU |
| 5974 | 8 | AACUACGACAUCGUCAUCGGA |
| 5975 | 9 | UACCUGAAGACUAUGUUCCUU |
| 5976 | 10 | UUGAUGGUACCUUGAAUCGUG |
| 5977 | 11 | UUUCCUGCUUCCUUCAACCGU |
| 5978 | 12 | UAAGAUGUCAUCACAAGUGGU |
| 5979 | 13 | UUACUCACACCUAGUCGCCGA |
| 5980 | 14 | UUGCACAUGAAUCCAGUUGAG |
| 5981 | 15 | UUCGAUGUAGACACUCCUCUU |
| 5982 | 16 | UCUGAUAGCAGGUUCUUGCGU |
| 5983 | 17 | UUCACCACUCUUCUGAUCUUU |
| 5984 | 18 | UCGAUGACUUGUUUCAUCCAG |
| 5985 | 19 | UUUAACCUCCUGAAGCUGCUG |
| 5986 | 20 | UUGUAGAUCUCAAAGAAUGAG |
| 5987 | 21 | UUGAGAUCUUUCACAUAGGGA |
| 5988 | 22 | AAUAUCUUUAAUAUAACUGUU |
| 5989 | 23 | UACGACAUCGUCAUCGGACAG |
| 5990 | 24 | UUCUAAUAGGUCAUAAAGCAG |
| 5991 | 25 | UUUCAACACAGUAUGAUACUG |
| 5992 | 26 | AUGACUUGUUUCAUCCAGCUG |
| 5993 | 27 | UGGAACACUCGAGUCAACUUG |
| 5994 | 28 | UACAUCCUUUACCAUCUCCUU |
| 5995 | 29 | AUCUGCUUGCUGUCUAGCCAG |
| 5996 | 30 | AACACUCGAGUCAACUUGCUG |
| 5997 | 31 | UUCACUGCACCACUGUUCCCG |
| 5998 | 32 | UUAUGCAACUCUUCAGUGGUA |
| 5999 | 33 | UUGGAGGCUAUUGAAGAUCAG |
| 6000 | 34 | UUCAGGAGAGUAGCUGACCCA |
| 6001 | 35 | UAUAAUUCCUGAUAUAUGGUA |
| 6002 | 36 | UUGAUUAAGAUGUCAUCACAA |
| 6003 | 37 | UCACAGAGUGACAGCUCGCUG |

TABLE 9-continued

Results for KIF20A.
Score threshold: 70. Design: siRNA 21 nt.

| SEQ ID NO | siRNA_id | AS Sequence |
|---|---|---|
| 6004 | 38 | UUCCACAACUUGUAGGAGCUC |
| 6005 | 39 | UUGUAGAACAAGGGUCUCCAC |
| 6006 | 40 | UUUCACUAGCACCAUGUUGUU |
| 6007 | 41 | UUUACCAUCUCCUUCACAGUU |
| 6008 | 42 | UGUUCUACCAUCUCAUUGCAA |
| 6009 | 43 | UAAUCUUUAAUAUAACUGU |
| 6010 | 44 | UUGUCCUCUAGGGAGGUAGAG |
| 6011 | 45 | UUUCUGAAGCUCUGUCCGCAA |
| 6012 | 46 | UUCUUCAUUUCCUCCUGUCGG |
| 6013 | 47 | AUCUCGGAGAUGCAUCUCCAG |
| 6014 | 48 | UACUUAUGCAACUCUUCAGUG |
| 6015 | 49 | UAGCACCAUGUUGUUCUGCAG |
| 6016 | 50 | AUACAUGCUGCCUUCUUCCGA |
| 6017 | 51 | UUAGGUUGAAGAAGGAUGCCU |
| 6018 | 52 | UCUGAUACUUAUGCAACUCUU |
| 6019 | 53 | UUAAGAUGUCAUCACAAGUGG |
| 6020 | 54 | UGCACUGCUGUAAUUUAGCUU |
| 6021 | 55 | UAUACUUUCACCUUCUCCAUA |
| 6022 | 56 | UUUCGAUGUAGACACUCCUCU |
| 6023 | 57 | UUUAGCUCUGCUUUGCACUGC |
| 6024 | 58 | UCGGAGAUGCAUCUCCAGCUG |
| 6025 | 59 | UACUGCUGGUACACUGACUGA |
| 6026 | 60 | UUCGUUGUAGAUCUCAAAGAA |
| 6027 | 61 | UAGAACAAGGGUCUCCACAUU |
| 6028 | 62 | UUCAUCUCGGAGAUGCAUCUC |
| 6029 | 63 | UAACUUCUUGUCCACAUCAAU |
| 6030 | 64 | UUCAGUGGUAGAGUUUAGCUC |
| 6031 | 65 | UCUCAAUACGGACACAACCCU |
| 6032 | 66 | UAGCAGGGACAGCUUCUUCAU |
| 6033 | 67 | UGUCUGAGUAUUGCAUCCUGG |
| 6034 | 68 | AUUUCUUCAGGAGAGUAGCUG |
| 6035 | 69 | AUCCUGAUUGAGAAGAUGCUG |
| 6036 | 70 | UUCUGGUUGAGGUGGGUGCUG |
| 6037 | 71 | UUGUCAGUGACUCCUUGAGGA |
| 6038 | 72 | UUCCUGUCGUUCCAACUCUGA |
| 6039 | 73 | UGACAGCUCGCUGAUCUUGGG |
| 6040 | 74 | UCUGAAGGUAACAAGGGCCUA |
| 6041 | 75 | UAUCUUUAAUAUAACUGUUUU |
| 6042 | 76 | UUAACCUCCUGAAGCUGCUGG |
| 6043 | 77 | UGUCGUUCCAACUCUGAAGGU |
| 6044 | 78 | UAGACACUCCUCUUCAAGGAA |
| 6045 | 79 | UUCCUUGAUGAACGAGUGCAG |
| 6046 | 80 | AUAUCUUUAAUAUAACUGUUU |
| 6047 | 81 | AUCUCAAAGAAUGAGAUCCAG |
| 6048 | 82 | UUUAGCUUUAACCUCCUGAAG |
| 6049 | 83 | UAACCUCCUGAAGCUGCUGGG |
| 6050 | 84 | UACUCACACCUAGUCGCCGAA |
| 6051 | 85 | UUGCAUCUGUUCUACCAUCUC |
| 6052 | 86 | UUCCUGCUUCCUUCAACCGUU |
| 6053 | 87 | UGACUGAUAGAAGAGAGCCCA |
| 6054 | 88 | UCUUCAUUUCCUCCUGUCGGA |
| 6055 | 89 | UAGUCGCCGAAGCUGGACUUU |
| 6056 | 90 | UUGAUGAACGAGUGCAGGGAU |
| 6057 | 91 | UUUCAUCUAGGUAGAUGCAC |
| 6058 | 92 | UAGGUUGAAGAAGGAUGCCUG |
| 6059 | 93 | UGACUUGUUUCAUCCAGCUGG |
| 6060 | 94 | UUCACUAGCACCAUGUUGUUC |
| 6061 | 95 | UCUUCUGAUCUUUGCAGCGCU |
| 6062 | 96 | UGGUAGAGUUUAGCUCUGCUU |
| 6063 | 97 | UCUGAGUAUUGCAUCCUGGAU |
| 6064 | 98 | AUAAUAUCUUUAAUAUAACUG |
| 6065 | 99 | UAGCAGGUUCUUGCGUACCAC |
| 6066 | 100 | UUCCUCCUGUCGGAUCUGCUU |
| 6067 | 101 | UUAGCUCUGCUUUGCACUGCU |
| 6068 | 102 | AACCCGAUCUUCCUGUCGUU |
| 6069 | 103 | UAGGCGGUUCUAAUAGGUCAU |
| 6070 | 104 | UCAUCGGACAGCAAGCCCGCU |
| 6071 | 105 | AUUCACAUUGACAAUCAUGCA |
| 6072 | 106 | UAAAUUUCGAAGGAAUGGUUU |
| 6073 | 107 | UCUUGCACAUGAAUCCAGUUG |
| 6074 | 108 | UUGGAGGCCUCCAUUUAGCAG |
| 6075 | 109 | UCCUGUCGGAUCUGCUUGCUG |
| 6076 | 110 | UUGGAGAGACUCACCAAGUUU |

TABLE 9-continued

Results for KIF20A.
Score threshold: 70. Design: siRNA 21 nt.

| SEQ ID NO | siRNA_id | AS Sequence |
|---|---|---|
| 6077 | 111 | UCGAUGUAGACACUCCUCUUC |
| 6078 | 112 | UUGCACUGCUGUAAUUUAGCU |
| 6079 | 113 | AAGCUCUCUCUGCUGAUUGGA |
| 6080 | 114 | UACAUGCUGCCUUCUUCCGAA |
| 6081 | 115 | UACUGCUCAGCAAUACAUGCU |
| 6082 | 116 | AUUGAGAAGAUGCUGUGACUG |
| 6083 | 117 | AACUUGUAGGAGCUCCUCUUU |
| 6084 | 118 | UAGAGACGACAGAGCAGUCUG |
| 6085 | 119 | UAAUAGGUCAUAAAGCAGUUC |
| 6086 | 120 | UUGGAGUUUCAACACAGUAUG |
| 6087 | 121 | UUACCAUCUCCUUCACAGUUA |
| 6088 | 122 | UCCAUAUGUAUAGAUGAGCCA |
| 6089 | 123 | UGCAUCUGUUCUACCAUCUCA |
| 6090 | 124 | AUCACAGAGUGACAGCUCGCU |
| 6091 | 125 | UGCUUGUAGAACAAGGGUCUC |
| 6092 | 126 | UUCUUGCGUACCACAGACCCC |
| 6093 | 127 | UAGCCGCAAAGUCUGCCUCUU |
| 6094 | 128 | UUUGUGACCGCCGUAGGGCCA |
| 6095 | 129 | AUGCAUCUCCAGCUGUAGCUU |
| 6096 | 130 | AGCUCUGUCCGCAACAGCCUU |
| 6097 | 131 | UUUGCCGGGACAGGUAGUGGG |
| 6098 | 132 | UACGGACACAACCCUGAUCUU |
| 6099 | 133 | UCUUCCUGUCGUUCCAACUCU |
| 6100 | 134 | UGUUGUUCUGCAGUUCAGCCA |
| 6101 | 135 | UACACUGACUGAUAGAAGAGA |
| 6102 | 136 | AAGAAUGAGAUCCAGAUGGAG |
| 6103 | 137 | AACAGCCUUAUAUUCUUCGG |
| 6104 | 138 | UCAUAGGUAGAUGCACAGGGA |
| 6105 | 139 | UCUUGCGUACCACAGACCCCA |
| 6106 | 140 | AUCUUUAAUAUAACUGUUUUU |
| 6107 | 141 | UUCUGAUCUUUGCAGCGCUCU |
| 6108 | 142 | AGAAACCUUGGAACACUCGAG |
| 6109 | 143 | UUGGAACACUCGAGUCAACUU |
| 6110 | 144 | AUUGCAAAUUUCAUCUCGGAG |
| 6111 | 145 | UGUAGGAGCUCCUCUUUGCCA |
| 6112 | 146 | UGCAUCUCCAGCUGUAGCUUU |
| 6113 | 147 | UUCUUCAGGAGAGUAGCUGAC |
| 6114 | 148 | UCACCUUCUCCAUACUGUCCU |
| 6115 | 149 | UUAGUGACUCCAUAUGUAUAG |
| 6116 | 150 | UGAAGAAGGAUGCCUGUCCCA |
| 6117 | 151 | AAUUUCAUCUCGGAGAUGCAU |
| 6118 | 152 | AAGCUCUGUCCGCAACAGCCU |
| 6119 | 153 | UCUCAUUGCAAAUUUCAUCUC |
| 6120 | 154 | UCAUUGCAAAUUUCAUCUCGG |
| 6121 | 155 | UUGCCGGGACAGGUAGUGGGG |
| 6122 | 156 | UCGGAUCUGCUUGCUGUCUAG |
| 6123 | 157 | ACAUUGACAAUCAUGCAGGAA |
| 6124 | 158 | UAUGCAACUCUUCAGUGGUAG |
| 6125 | 159 | UACCUCAUUGGAGAGCAAGGG |
| 6126 | 160 | AAGUUUCUGAAGCUCUGUCCG |
| 6127 | 161 | AAGAAACCUUGGAACACUCGA |
| 6128 | 162 | UAUUUCUUCAGGAGAGUAGCU |
| 6129 | 163 | AUGUGAACAAUAAUAUCUUUA |
| 6130 | 164 | UGAUAGAAGAGAGCCCAGCAA |
| 6131 | 165 | UCUAACUUCUUGUCCACAUCA |
| 6132 | 166 | AAUAUCAUCAUCAAGGCCUGU |
| 6133 | 167 | UCUGAUCUUUGCAGCGCUCUG |
| 6134 | 168 | UCUUCUAACUUCUUGUCCACA |
| 6135 | 169 | UGGUACCUUGAAUCGUGUGGG |
| 6136 | 170 | UUUCUUCAGGAGAGUAGCUGA |
| 6137 | 171 | ACACAGUAUGAUACUGCUCAG |
| 6138 | 172 | UUUAGCAGGGACAGCUUCUUC |
| 6139 | 173 | UAGCUUUAACCUCCUGAAGCU |
| 6140 | 174 | AUCUGUUCUACCAUCUCAUUG |
| 6141 | 175 | AUCGAUGACUUGUUUCAUCCA |
| 6142 | 176 | UGAUCUUUGCAGCGCUCUGAG |
| 6143 | 177 | UCCUCCUGUCGGAUCUGCUUG |
| 6144 | 178 | UUUGAUUAAGAUGUCAUCACA |
| 6145 | 179 | AUGAAUCCAGUUGAGAUCUUU |
| 6146 | 180 | AGCUUCUAGCUCUUCAAUCUU |
| 6147 | 181 | UUGUAGGAGCUCCUCUUUGCC |
| 6148 | 182 | AUCUCCUUCACAGUUAGGUUG |
| 6149 | 183 | UGUCAGUGACUCCUUGAGGAU |

TABLE 9-continued

Results for KIF20A.
Score threshold: 70. Design: siRNA 21 nt.

| SEQ ID NO | siRNA_id | AS Sequence |
|---|---|---|
| 6150 | 184 | UUCUCCAUACUGUCCUCAGAU |
| 6151 | 185 | AUCUUGCACAUGAAUCCAGUU |
| 6152 | 186 | AGCAUCUUGCACAUGAAUCCA |
| 6153 | 187 | UUCACAGUUAGGUUGAAGAAG |
| 6154 | 188 | AGUGACAGCUCGCUGAUCUUG |
| 6155 | 189 | UAACAAGGGCCUAACCCUCAA |
| 6156 | 190 | UAGAGUUUAGCUCUGCUUUGC |
| 6157 | 191 | AUGAGAGUUUCAUCAUAGGU |
| 6158 | 192 | ACUGCUGGUACACUGACUGAU |
| 6159 | 193 | UGCUGCUUGUCCUCUAGGGAG |
| 6160 | 194 | UCAUCAUAGGUAGAUGCACAG |
| 6161 | 195 | UUGAGUACAUCCUUUACCAUC |
| 6162 | 196 | UGGACUUUCGCAGCCGCAGAG |
| 6163 | 197 | AACUCUGAAGGUAACAAGGGC |
| 6164 | 198 | UGAGAAGAUGCUGUGACUGCG |
| 6165 | 199 | UGCAACUCUUCAGUGGUAGAG |
| 6166 | 200 | UUGUCCACAUCAAUGGUGAAG |
| 6167 | 201 | ACCAGGUUCUGCUUUGACCGG |
| 6168 | 202 | AUAGGUCAUAAAGCAGUUCGU |
| 6169 | 203 | UUAGCAGGGACAGCUUCUUCA |
| 6170 | 204 | UUCAACACAGUAUGAUACUGC |
| 6171 | 205 | AAGUGGUCAAGGCUUGACGAA |
| 6172 | 206 | CUAACUUCUUGUCCACAUCAA |
| 6173 | 207 | AGCUUUAACCUCCUGAAGCUG |
| 6174 | 208 | UAGAUGCACAGGGAUUCACAU |
| 6175 | 209 | AUUAAGAUGUCAUCACAAGUG |
| 6176 | 210 | UGGUUGUGGUUUGGUUGCUG |
| 6177 | 211 | UAAGGGCUGCAGUCUGUUGAG |
| 6178 | 212 | AUACCUGAAGACUAUGUUCCU |
| 6179 | 213 | UGAAGAGUUUCAUCAUAGGUA |
| 6180 | 214 | AAGACUAUGUUCCUUGAUGAA |
| 6181 | 215 | UGCUUUGACCGGUUCUGCUGG |
| 6182 | 216 | UGGAGUUUCAACACAGUAUGA |
| 6183 | 217 | UCAUAAAGCAGUUCGUUGUAG |
| 6184 | 218 | ACUUUCGAUGUAGACACUCCU |
| 6185 | 219 | AUCAUAGGUAGAUGCACAGGG |
| 6186 | 220 | UCCAGUUUCACUAGCACCAUG |
| 6187 | 221 | AAACAUGGGAGAAACUACGAC |
| 6188 | 222 | AACCUUGGAACACUCGAGUCA |
| 6189 | 223 | AACAACAUGAGAUUACAUAGG |
| 6190 | 224 | UGCCUUCUUCCGAAGGUCCAG |
| 6191 | 225 | UUUCGCAGCCGCAGAGCACAA |
| 6192 | 226 | AUACUUAUGCAACUCUUCAGU |
| 6193 | 227 | UCCUGAUAUAUGGUAAAGCAU |
| 6194 | 228 | AAUGUUUCCUGCUUCCUUCAA |
| 6195 | 229 | UGGAACCUGCUGCUUGUCCUC |
| 6196 | 230 | AAACCUUGGAACACUCGAGUC |
| 6197 | 231 | AACAUGAGAUUACAUAGGUGG |
| 6198 | 232 | AUGACUGCUCUUCUCUUUCCC |
| 6199 | 233 | AGGUGUAGGAUCCUGAUUGAG |
| 6200 | 234 | UCAAGGAAGUGGACAGCUCCU |
| 6201 | 235 | UUAAUGUUUCCUGCUUCCUUC |
| 6202 | 236 | CAACAUGAGAUUACAUAGGUG |
| 6203 | 237 | AAGCAGUUCGUUGUAGAUCUC |
| 6204 | 238 | UGAGAUCUUUCACAUAGGGAU |
| 6205 | 239 | UGAAGGUGUAGGAUCCUGAUU |
| 6206 | 240 | AACAAUAAUAUCUUUAAUAUA |
| 6207 | 241 | AUUUAGCAGGGACAGCUUCUU |
| 6208 | 242 | UUGAAGAAGGAUGCCUGUCCC |
| 6209 | 243 | UACAUGGAGAUGUCAGCUUCA |
| 6210 | 244 | AUAUAAUUCCUGAUAUAUGGU |
| 6211 | 245 | UGCAAGAGAGCUUCUAGCUCU |
| 6212 | 246 | UAACCCUCAAGUAUACUUUCA |
| 6213 | 247 | CUGAUCUUCCUGUCGUUCCAA |
| 6214 | 248 | UGCAGCUGUGGACUCAAACAU |
| 6215 | 249 | UAGGGAGGUAGAGACGACAGA |
| 6216 | 250 | AAAUGUUCACUGCACCACUGU |
| 6217 | 251 | UUGUGACCGCCGUAGGGCCAA |
| 6218 | 252 | UCCAUUUAGCAGGGACAGCUU |
| 6219 | 253 | UCCAGUUGAGAUCUUUCACAU |
| 6220 | 254 | UGAUGGUACCUUGAAUCGUGU |
| 6221 | 255 | UUGACCGGUUCUGCUGGUUUU |
| 6222 | 256 | ACAACAUGAGAUUACAUAGGU |

TABLE 9-continued

Results for KIF20A.
Score threshold: 70. Design: siRNA 21 nt.

| SEQ ID NO | siRNA_id | AS Sequence |
|---|---|---|
| 6223 | 257 | UGGACAGCUCCUCCUCUUGGA |
| 6224 | 258 | AGUGUCUGAGUAUUGCAUCCU |
| 6225 | 259 | UCCUGUCGUUCCAACUCUGAA |
| 6226 | 260 | UGUCGGAUCUGCUUGCUGUCU |
| 6227 | 261 | UACCAUCUCCUUCACAGUUAG |
| 6228 | 262 | UGCCCUUUGAGUACAUCCUUU |
| 6229 | 263 | AAUACAUGCUGCCUUCUUCCG |
| 6230 | 264 | UCUUUGCAGCGCUCUGAGCCA |
| 6231 | 265 | UCACAUUGACAAUCAUGCAGG |
| 6232 | 266 | UCAACACAGUAUGAUACUGCU |
| 6233 | 267 | AAGUGGACAGCUCCUCCUCUU |
| 6234 | 268 | UUUCACCUUCUCCAUACUGUC |
| 6235 | 269 | UGCUGGUACCUAUCCGACUUU |
| 6236 | 270 | UCGGCCUGUGAAGAAACCUUG |
| 6237 | 271 | UAAUGUUCCUGCUUCCUUCA |
| 6238 | 272 | AACAGGGUCUCCACAUUCUC |
| 6239 | 273 | AUCCUGGAUAUAAUUCCUGAU |
| 6240 | 274 | AAUCCCUCCAUCCUUGAUGGU |
| 6241 | 275 | CUUGAUGGUACCUUGAAUCGU |
| 6242 | 276 | AAAGUCUGCCUCUUGCGCUGU |
| 6243 | 277 | UCAGAUGGAACCUGCUGCUUG |
| 6244 | 278 | AACCGUUCACCACUCUUCUGA |
| 6245 | 279 | UUUCCUCCAAUAGUUCCUUUU |
| 6246 | 280 | UGCACCACUGUUCCCGCUGUU |
| 6247 | 281 | AAUGUUCACUGCACCACUGUU |
| 6248 | 282 | UGCAGGAACGGCCUCGGCCUG |
| 6249 | 283 | AAUUUAGCUUUAACCUCCUGA |
| 6250 | 284 | CUUACUCACACCUAGUCGCCG |
| 6251 | 285 | CUAUGUUCCUUGAUGAACGAG |
| 6252 | 286 | UUGUUGGUUUGGUUGCUGAUU |
| 6253 | 287 | AGUUUACUAGCACCAUGUUG |
| 6254 | 288 | UCGUCAUCGGACAGCAAGCCC |
| 6255 | 289 | UUCUAACUUCUUGUCCACAUC |
| 6256 | 290 | UCUGCUUUGACCGGUUCUGCU |
| 6257 | 291 | UGAUGGAGAGACUCACCAAG |
| 6258 | 292 | UCAGUGGUAGAGUUUAGCUCU |
| 6259 | 293 | UCAAUAUCAUCAUCAAGGCCU |
| 6260 | 294 | CUCAAUACGGACACAACCCUG |
| 6261 | 295 | UGAGUUAGUGACUCCAUAUGU |
| 6262 | 296 | UGGAGUUCUGGUUGAGGUGGG |
| 6263 | 297 | ACAACUUGUAGGAGCUCCUCU |
| 6264 | 298 | UACUGUCCUCAGAUGGAACCU |
| 6265 | 299 | AAAUCUGCAGCUGUGGACUCA |
| 6266 | 300 | CUUCUUGUCCACAUCAAUGGU |
| 6267 | 301 | UGCUUGUCCUCUAGGGAGGUA |
| 6268 | 302 | UCUAAUAGGUCAUAAAGCAGU |
| 6269 | 303 | UGCAUAGAAAUCAUAUAAGUA |
| 6270 | 304 | AGUUUCUGAAGCUCUGUCCGC |
| 6271 | 305 | ACAGAGUGACAGCUCGCUGAU |
| 6272 | 306 | UGAUACUGCUCAGCAAUACAU |
| 6273 | 307 | ACACUCGAGUCAACUUGCUGU |
| 6274 | 308 | UGAUACUUAUGCAACUCUUCA |
| 6275 | 309 | CAACCGUUCACCACUCUUCUG |
| 6276 | 310 | UCCUUGAGGAUAUUUAGUUUU |
| 6277 | 311 | UUCUAGCUCUUCAAUCUUUUC |
| 6278 | 312 | GUGUCUGAGUAUUGCAUCCUG |
| 6279 | 313 | ACUUAUGCAACUCUUCAGUGG |
| 6280 | 314 | CUUCCUGUCGUUCCAACUCUG |
| 6281 | 315 | ACUUGUAGGAGCUCCUCUUUG |
| 6282 | 316 | UAUCCGACUUUCGAUGUAGAC |
| 6283 | 317 | AAACUACGACAUCGUCAUCGG |
| 6284 | 318 | ACUGCUCAGCAAUACAUGCUG |
| 6285 | 319 | AUUCAGACCCUGAUUGCUGAU |
| 6286 | 320 | UGUAAUUUAGCUUUAACCUCC |
| 6287 | 321 | UCCUGUUUGAUUAAGAUGUCA |
| 6288 | 322 | UCGCAUAGCCGCAAAGUCUGC |
| 6289 | 323 | UGGGUGCUUGUAGAACAAGGG |
| 6290 | 324 | AACUCUUCAGUGGUAGAGUUU |
| 6291 | 325 | AUUGGAGAGACUCACCAAGUU |
| 6292 | 326 | AUUUCCUCCAAUAGUUCCUUU |
| 6293 | 327 | UUCUGCUUUGACCGGUUCUGC |
| 6294 | 328 | UCCAACUCUGAAGGUAACAAG |
| 6295 | 329 | UGACUGCUCUUCUCUUUCCCC |

TABLE 9-continued

Results for KIF20A.
Score threshold: 70. Design: siRNA 21 nt.

| SEQ ID NO | siRNA_id | AS Sequence |
|---|---|---|
| 6296 | 330 | UUUCCUCCUGUCGGAUCUGCU |
| 6297 | 331 | GACACAACCCUGAUCUUCCUG |
| 6298 | 332 | UUGCAAAUUUCAUCUCGGAGA |
| 6299 | 333 | AUGUAGACACUCCUCUUCAAG |
| 6300 | 334 | AAGGGAACCAGGUUCUGCUUU |
| 6301 | 335 | UUCAUUGCUCUUCAGGGCAAA |
| 6302 | 336 | AAGUCUGCCUCUUGCGCUGUU |
| 6303 | 337 | AAUCCCAGUUGCAUAGGUGGG |
| 6304 | 338 | ACUAUGUUCCUUGAUGAACGA |
| 6305 | 339 | ACAGUUAGGUUGAAGAAGGAU |
| 6306 | 340 | UUCCUGCAAGAGAGCUUCUAG |
| 6307 | 341 | UGUAGGAUCCUGAUUGAGAAG |
| 6308 | 342 | UUCCAACUCUGAAGGUAACAA |
| 6309 | 343 | UAGGAUCCUGAUUGAGAAGAU |
| 6310 | 344 | AUCAGGUGUUGGAUGAAGUUG |
| 6311 | 345 | AACACAGUAUGAUACUGCUCA |
| 6312 | 346 | UCCUUGAUGAACGAGUGCAGG |
| 6313 | 347 | UAGAUCUCAAAGAAUGAGAUC |
| 6314 | 348 | ACUGUCCUCAGAUGGAACCUG |
| 6315 | 349 | ACCUUGGAACACUCGAGUCAA |
| 6316 | 350 | AACCUCCUGAAGCUGCUGGGU |
| 6317 | 351 | UCUGGUUCUUACGACCCACUU |
| 6318 | 352 | UCAAUACGGACACAACCCUGA |
| 6319 | 353 | UACCUUGAAUCGUGUGGGUUU |
| 6320 | 354 | GAUACUUAUGCAACUCUUCAG |
| 6321 | 355 | UAGUGUCUGAGUAUUGCAUCC |
| 6322 | 356 | UCGUUGUAGAUCUCAAAGAAU |
| 6323 | 357 | AACCUGCUGCUUGUCCUCUAG |
| 6324 | 358 | AUCCCAGUUGCAUAGGUGGGG |
| 6325 | 359 | AGAGCAGUCUGAUAGCAGGUU |
| 6326 | 360 | UGUAGAGAGGUGUUAAUGUUU |
| 6327 | 361 | UCUCCACAUUCUCAAUACGGA |
| 6328 | 362 | UCCCUGAGUUAGUGACUCCAU |
| 6329 | 363 | AUCAAGUGGUCAAGGCUUG |
| 6330 | 364 | ACUUUCACCUUCUCCAUACUG |
| 6331 | 365 | CUUUGCAGCGCUCUGAGCCAG |
| 6332 | 366 | AAGAUGCUGUGACUGCGGCUG |
| 6333 | 367 | AUGGUACCUUGAAUCGUGUGG |
| 6334 | 368 | CAACACAGUAUGAUACUGCUC |
| 6335 | 369 | AUCCUUUACCAUCUCCUUCAC |
| 6336 | 370 | UCUUCAUACAUUUCCUCCAAU |
| 6337 | 371 | UUCAAGGAAGUGGACAGCUCC |
| 6338 | 372 | UACCUAUCCGACUUUCGAUGU |
| 6339 | 373 | CUGCCCUUUGAGUACAUCCUU |
| 6340 | 374 | UUGAGAAGAUGCUGUGACUGC |
| 6341 | 375 | UCAAAGAAUGAGAUCCAGAUG |
| 6342 | 376 | UUGGUUUGGUUGCUGAUUUUC |
| 6343 | 377 | AUAGCCGCAAAGUCUGCCUCU |
| 6344 | 378 | UGCAAAUUUCAUCUCGGAGAU |
| 6345 | 379 | UCAGGAGAGUAGCUGACCCAC |
| 6346 | 380 | UGUAGAACAAGGGUCUCCACA |
| 6347 | 381 | CUGAUUGGAGAGACUCACCAA |
| 6348 | 382 | UCUUUCACAUAGGGAUUGCCA |
| 6349 | 383 | UCAAGUAUACUUUCACCUUCU |
| 6350 | 384 | AUUUAGCUUUAACCUCCUGAA |
| 6351 | 385 | AUCCCUUGCGACAUGACGGCA |
| 6352 | 386 | UGCUGGUACACUGACUGAUAG |
| 6353 | 387 | AAUCCAGUUGAGAUCUUUCAC |
| 6354 | 388 | CUGAAGACUAUGUUCCUUGAU |
| 6355 | 389 | AGCAGUUCGUUGUAGAUCUCA |
| 6356 | 390 | UUGGGUGCUUGUAGAACAAGG |
| 6357 | 391 | UACAUUUGGAAUUCAAUAAAA |
| 6358 | 392 | UCCUGAUCUCUUCUUGGUAA |
| 6359 | 393 | UGAACGAGUGCAGGGAUGGGA |
| 6360 | 394 | UGCAUCCUGGAUAUAAUUCCU |
| 6361 | 395 | AUUUCGAAGGAAUGGUUUCUU |
| 6362 | 396 | UGUUAAUGUUCCUGCUUCCU |
| 6363 | 397 | ACUCUUCUGAUCUUUGCAGCG |
| 6364 | 398 | UGUUCCUUGAUGAACGAGUGC |
| 6365 | 399 | CUGUAAUUUAGCUUUAACCUC |
| 6366 | 400 | GAACACUCGAGUCAACUUGCU |
| 6367 | 401 | UGGUACCUAUCCGACUUUCGA |
| 6368 | 402 | UCAACCGUUCACCACUCUUCU |

TABLE 9-continued

Results for KIF20A.
Score threshold: 70. Design: siRNA 21 nt.

| SEQ ID NO | siRNA_id | AS Sequence |
|---|---|---|
| 6369 | 403 | UCCACAUCAAUGGUGAAGGGC |
| 6370 | 404 | UCGAGUCAACUUGCUGUCACG |
| 6371 | 405 | UUCUCAAUACGGACACAACCC |
| 6372 | 406 | ACAGCUUCUUCAUUUCCUCCU |
| 6373 | 407 | CAACUUGUAGGAGCUCCUCUU |
| 6374 | 408 | UGAAGCUGCGGGUGGAGGCA |
| 6375 | 409 | UGGGAGAAACUACGACAUCGU |
| 6376 | 410 | UAGGUGGUUAUAAUACAAAAG |
| 6377 | 411 | GACAGCUCGCUGAUCUUGGGG |
| 6378 | 412 | ACCAAGUUUCUGAAGCUCUGU |
| 6379 | 413 | UAAAGCAGUUCGUUGUAGAUC |
| 6380 | 414 | ACUUGUCAGUGACUCCUUGAG |
| 6381 | 415 | UUCACCUUCUCCAUACUGUCC |
| 6382 | 416 | GUAUACUUUCACCUUCUCCAU |
| 6383 | 417 | CAGUGGUAGAGUUUAGCUCUG |
| 6384 | 418 | UCCAAAUGUUCACUGCACCAC |
| 6385 | 419 | AUGGUUUCUUCCCUGGUGGUU |
| 6386 | 420 | AGAGACGACAGAGCAGUCUGA |
| 6387 | 421 | UGUGAAGAAACCUUGGAACAC |
| 6388 | 422 | UUCAACCGUUCACCACUCUUC |
| 6389 | 423 | UGCACAGGGAUUCACAUUGAC |
| 6390 | 424 | UGACAAUCAUGCAGGAACGGC |
| 6391 | 425 | AUACAUGGAGAUGUCAGCUUC |
| 6392 | 426 | AUAAAGCAGUUCGUUGUAGAU |
| 6393 | 427 | CAUGAGAUUACAUAGGUGGUU |
| 6394 | 428 | CUCUUCUAACUUCUUGUCCAC |
| 6395 | 429 | CACACCUAGUCGCCGAAGCUG |
| 6396 | 430 | GACAUCGUCAUCGGACAGCAA |
| 6397 | 431 | ACUAGCACCAUGUUGUUCUGC |
| 6398 | 432 | UAGCUGACCCACCUCAGGGCC |
| 6399 | 433 | ACUCGAGUCAACUUGCUGUCA |
| 6400 | 434 | AAGGGCUUCAGAUCAGGUGUU |
| 6401 | 435 | AACCAGGUUCUGCUUUGACCG |
| 6402 | 436 | UGAACAAUAAUAUCUUUAAUA |
| 6403 | 437 | UUCAUCAUAGGUAGAUGCACA |
| 6404 | 438 | UGAGGGUGGUGGUUCUAACAU |
| 6405 | 439 | UCAGAUCAGGUGUUGGAUGAA |
| 6406 | 440 | UUCCUCCAAUAGUUCCUUUUG |
| 6407 | 441 | AGCUUCUUCAUUUCCUCCUGU |
| 6408 | 442 | ACAUCGUCAUCGGACAGCAAG |
| 6409 | 443 | AGAGAGCUUCUAGCUCUUCAA |
| 6410 | 444 | CAUUGCAAAUUUCAUCUCGGA |
| 6411 | 445 | AAGAGUUUCAUCAUAGGUAGA |
| 6412 | 446 | AAGCUGGACUUUCGCAGCCGC |
| 6413 | 447 | AUCGUCAUCGGACAGCAAGCC |
| 6414 | 448 | UUUCGAAGGAAUGGUUUCUUC |
| 6415 | 449 | UCCUUUACCAUCUCCUUCACA |
| 6416 | 450 | CAGCUUCUUCAUUUCCUCCUG |
| 6417 | 451 | CAACUCUGAAGGUAACAAGGG |
| 6418 | 452 | UGGGUGUCCAAAUGUUCACUG |
| 6419 | 453 | UAGGAUCCGGGCAUAAGGGCU |
| 6420 | 454 | ACAUGAGAUUACAUAGGUGGU |
| 6421 | 455 | ACCACUCUUCUGAUCUUUGCA |
| 6422 | 456 | UACCAUCUCAUUGCAAAUUUC |
| 6423 | 457 | ACAUCCUUUACCAUCUCCUUC |
| 6424 | 458 | UGAAGAAACCUUGGAACACUC |
| 6425 | 459 | UCUUGUCCACAUCAAUGGUGA |
| 6426 | 460 | UAGUGACUCCAUAUGUAUAGA |
| 6427 | 461 | UCAUCACAAGUGGUCAAGGCU |
| 6428 | 462 | CACAACUUGUAGGAGCUCCUC |
| 6429 | 463 | AAGAUGUCAUCACAAGUGGUC |
| 6430 | 464 | AAUCUGCAGCUGUGGACUCAA |
| 6431 | 465 | UCCAUCCUUGAUGGUACCUUG |
| 6432 | 466 | UGGAGAAGCGAAUGUUUGCCG |
| 6433 | 467 | UACAUUUCCUCCAAUAGUUCC |
| 6434 | 468 | UCGAAGCUGGUGCUGGUACCU |
| 6435 | 469 | AUGAACGAGUGCAGGGAUGGG |
| 6436 | 470 | AGCUGUGGACUCAAACAUGGG |
| 6437 | 471 | UCUGCUGAUUGGAGAGACUCA |
| 6438 | 472 | ACCUUUGUGACCGCCGUAGGG |
| 6439 | 473 | CACAUUGACAAUCAUGCAGGA |
| 6440 | 474 | CAGUAUGAUACUGCUCAGCAA |
| 6441 | 475 | UGACCGGUUCUGCUGGUUUUG |

TABLE 9-continued

Results for KIF20A.
Score threshold: 70. Design: siRNA 21 nt.

| SEQ ID NO | siRNA_id | AS Sequence |
|---|---|---|
| 6442 | 476 | UGAGAUUACAUAGGUGGUUAU |
| 6443 | 477 | AAAGAAUGAGAUCCAGAUGGA |
| 6444 | 478 | AUGUUCCUUGAUGAACGAGUG |
| 6445 | 479 | UCUCCUUCACAGUUAGGUUGA |
| 6446 | 480 | UCUCUCUGCUGAUUGGAGAGA |
| 6447 | 481 | UCACAAGUGGUCAAGGCUUGA |
| 6448 | 482 | CUGUUGCAUCUGUUCUACCAU |
| 6449 | 483 | UUUCAUCUCGGAGAUGCAUCU |
| 6450 | 484 | UAUUGCAUCCUGGAUAUAAUU |
| 6451 | 485 | CUGCUUUGACCGUUCUGCUG |
| 6452 | 486 | AGCUCUGGUUCUUACGACCCA |
| 6453 | 487 | AAGUAUACUUUCACCUUCUCC |
| 6454 | 488 | ACACUGACUGAUAGAAGAGAG |
| 6455 | 489 | ACAUAGGUGGUUAUAAUACAA |
| 6456 | 490 | GCAUCUUGCACAUGAAUCCAG |
| 6457 | 491 | UCUGCCCUUUGAGUACAUCCU |
| 6458 | 492 | UUGGAGAGCAAGGGCUUCAGA |
| 6459 | 493 | AGGUGUUAAUGUUUCCUGCUU |
| 6460 | 494 | CUCCUGAAUCUCUUCUUGGUA |
| 6461 | 495 | UGAAGCUCUGUCCGCAACAGC |
| 6462 | 496 | UCCUGAUUGAGAAGAUGCUGU |
| 6463 | 497 | UUCUGAAGCUCUGUCCGCAAC |
| 6464 | 498 | AUGGAACCUGCUGCUUGUCCU |
| 6465 | 499 | AGGAAGUGGACAGCUCCUCCU |
| 6466 | 500 | CUGAUCUUUGCAGCGCUCUGA |
| 6467 | 501 | UAUGAUACUGCUCAGCAAUAC |
| 6468 | 502 | CAUAGGUAGAUGCACAGGGAU |
| 6469 | 503 | ACCUAUCCGACUUUCGAUGUA |
| 6470 | 504 | AAGGUGUAGGAUCCUGAUUGA |
| 6471 | 505 | UGUCCUCAGAUGGAACCUGCU |
| 6472 | 506 | AUAUCAUCAAGGCCUGUG |
| 6473 | 507 | UCUUCAAGGAAGUGGACAGCU |
| 6474 | 508 | UGUUUGAUUAAGAUGUCAUCA |
| 6475 | 509 | UGAUUAAGAUGCAUCACAAG |
| 6476 | 510 | UCUGGUUGAGGUGGGUGCUGG |
| 6477 | 511 | UUUGACCGGUUCUGCUGGUUU |
| 6478 | 512 | UAAUUCCUGAUAUAUGGUAAA |
| 6479 | 513 | UGACUCCUUGAGGAUAUUUAG |
| 6480 | 514 | AGCUAGUGUCUGAGUAUUGCA |
| 6481 | 515 | UCGCCGAAGCUGGACUUUCGC |
| 6482 | 516 | UCACACCUAGUCGCCGAAGCU |
| 6483 | 517 | CUUUCGAUGUAGACACUCCUC |
| 6484 | 518 | UGUUGCAUCUGUUCUACCAUC |
| 6485 | 519 | UCCCUUGCGACAUGACGGCAG |
| 6486 | 520 | UGUCACGGAAGGGAACCAGGU |
| 6487 | 521 | ACAUGGAGAUGUCAGCUUCAU |
| 6488 | 522 | ACUGCUGUAAUUUAGCUUUAA |
| 6489 | 523 | AAUGGUUUCUUCCCUGGUGGU |
| 6490 | 524 | ACAACAACAUGAGAUUACAUA |
| 6491 | 525 | UCAUGCAGGAACGGCCUCGGC |
| 6492 | 526 | UUGCUCCUCCUGGGAUACUGG |
| 6493 | 527 | UGGGUGCUGGUACCUAUCCGAC |
| 6494 | 528 | UGUGAACAAUAAUAUCUUUAA |
| 6495 | 529 | ACCUUCUCCAUACUGUCCUCA |
| 6496 | 530 | ACUUCUUGUCCACAUCAAUGG |
| 6497 | 531 | UGCACAUGAAUCCAGUUGAGA |
| 6498 | 532 | UAGGAGCUUCCAGGCCUCCUC |
| 6499 | 533 | CUUCCUGCAAGAGAGCUUCUA |
| 6500 | 534 | UCUUCCCUGGUGGUUGUUGGU |
| 6501 | 535 | AUAAUUCCUGAUAUAUGGUAA |
| 6502 | 536 | GUACCUUGAAUCGUGUGGGUU |
| 6503 | 537 | AUGUCAUCACAAGUGGUCAAG |
| 6504 | 538 | ACAGCUCGCUGAUCUUGGGA |
| 6505 | 539 | UACAUAGGUGGUUAUAAUACA |
| 6506 | 540 | UGAUAUAUGGUAAAGCAUAAA |
| 6507 | 541 | AGAGUAGCUGACCCACCUCAG |
| 6508 | 542 | UCAUUGGAGAGCAAGGGCUUC |
| 6509 | 543 | UGGAGAUGUCAGCUUCAUUUU |
| 6510 | 544 | UGACUCCAUAUGUAUAGAUGA |
| 6511 | 545 | CUGAUAGCAGGUUCUUGCGUA |
| 6512 | 546 | AUAAGGGCUGCAGUCUGUUGA |
| 6513 | 547 | AGAUCUUUCACAUAGGGAUUG |
| 6514 | 548 | UGAUUGAGAAGAUGCUGUGAC |

TABLE 9-continued

Results for KIF20A.
Score threshold: 70. Design: siRNA 21 nt.

| SEQ ID NO | siRNA_id | AS Sequence |
|---|---|---|
| 6515 | 549 | UGUUUGCCGGGACAGGUAGUG |
| 6516 | 550 | UCAACUUGCUGUCACGGAAGG |
| 6517 | 551 | AGCUCUGCUUUGCACUGCUGU |
| 6518 | 552 | UAGAAAUCAUAUAAGUAAAUA |
| 6519 | 553 | ACAUUCUCAAUACGGACACAA |
| 6520 | 554 | AUGCACAGGGAUUCACAUUGA |
| 6521 | 555 | GUCCAGUUUCACUAGCACCAU |
| 6522 | 556 | CUCAUUGCAAAUUUCAUCUCG |
| 6523 | 557 | GUUGAGAUCUUUCACAUAGGG |
| 6524 | 558 | CAGUCUGAUAGCAGGUUCUUG |
| 6525 | 559 | AGUCAACUUGCUGUCACGGAA |
| 6526 | 560 | UUUCUUCCCUGGUGGUUGUUG |
| 6527 | 561 | ACACCUAGUCGCCGAAGCUGG |
| 6528 | 562 | AUACAUUCCUCCAAUAGUUC |
| 6529 | 563 | AUCCAGUUGAGAUCUUUCACA |
| 6530 | 564 | GAUGGUACCUUGAAUCGUGUG |
| 6531 | 565 | AACAAGCUCUCUCUGCUGAUU |
| 6532 | 566 | UUAGCUUUAACCUCCUGAAGC |
| 6533 | 567 | ACAAUCAUGCAGGAACGGCCU |
| 6534 | 568 | CAAAUGUUCACUGCACCACUG |
| 6535 | 569 | ACAAGGGUCUCCACAUUCUCA |
| 6536 | 570 | AUCUUCCUGUCGUUCCAACUC |
| 6537 | 571 | AACUUCUUGUCCACAUCAAUG |
| 6538 | 572 | AUGAGAUUACAUAGGUGGUUA |
| 6539 | 573 | AAUCAUGCAGGAACGGCCUCG |
| 6540 | 574 | UUCAGAUCAGGUGUUGGAUGA |
| 6541 | 575 | CUGAUUGAGAAGAUGCUGUGA |
| 6542 | 576 | CAACUUGCUGUCACGGAAGGG |
| 6543 | 577 | AUUACCCAUUGGAGAGCAAG |
| 6544 | 578 | GUAAUUUAGCUUUAACCUCCU |
| 6545 | 579 | UCAAACAUGGGAGAAACUACG |
| 6546 | 580 | UCCACAACUUGUAGGAGCUCC |
| 6547 | 581 | UGGUCAAGGCUUGACGAAGUU |
| 6548 | 582 | CUGUUCUACCAUCUCAUUGCA |
| 6549 | 583 | UGCUUUGCACUGCUGUAAUUU |
| 6550 | 584 | UGGUACACUGACUGAUAGAAG |
| 6551 | 585 | UGAUCCUCGCAUAGCCGCAAA |
| 6552 | 586 | CUCAGCAAUACAUGCUGCCUU |
| 6553 | 587 | AGAUCACAGAGUGACAGCUCG |
| 6554 | 588 | CCACUCUUCUGAUCUUUGCAG |
| 6555 | 589 | UUCAUACAUUUCCUCCAAUAG |
| 6556 | 590 | AGUGACUCCAUAUGUAUAGAU |
| 6557 | 591 | UCUACCAUCUCAUUGCAAAUU |
| 6558 | 592 | CAACAAGCUCUCUCUGCUGAU |
| 6559 | 593 | CAACAGCCUUAUAUUCUUCUG |
| 6560 | 594 | CAAAGUCUGCCUCUUGCGCUG |
| 6561 | 595 | UGGUCCUGUUUGAUUAAGAUG |
| 6562 | 596 | CACAGAGUGACAGCUCGCUGA |
| 6563 | 597 | UGGUGGUUGUUGGUUUGGUUG |
| 6564 | 598 | UUCCUUCAACCGUUCACCACU |
| 6565 | 599 | AUCCUUGAUGGUACCUUGAAU |
| 6566 | 600 | ACAACCCUGAUCUUCCUGUCG |
| 6567 | 601 | UCAUACAUUUCCUCCAAUAGU |
| 6568 | 602 | CUCAGAUGGAACCUGCUGCUU |
| 6569 | 603 | AGAAACUACGACAUCGUCAUC |
| 6570 | 604 | UCGAAGGAAUGGUUUCUUCCC |
| 6571 | 605 | AAUGUUUGCCGGGACAGGUAG |
| 6572 | 606 | UCAUCUCGGAGAUGCAUCUCC |
| 6573 | 607 | AUAGCAGGUUCUUGCGUACCA |
| 6574 | 608 | GAUGUAGACACUCCUCUUCAA |
| 6575 | 609 | UGGUUCUUACGACCCACUUUU |
| 6576 | 610 | UUCCUGAUAUAUGGUAAAGCA |
| 6577 | 611 | AUGCUGUGACUGCGGCUGGAG |
| 6578 | 612 | AACUUGCUGUCACGGAAGGGA |
| 6579 | 613 | UCCAUACUGUCCUCAGAUGGA |
| 6580 | 614 | AGUCCUUGGGUGCUUGUAGAA |
| 6581 | 615 | UGACGAAGGGCAGCAAUACAG |
| 6582 | 616 | AUGUUCACUGCACCACUGUUC |
| 6583 | 617 | ACUACGACAUCGUCAUCGGAC |
| 6584 | 618 | UGACUGCGGCUGGAGUUCUGG |
| 6585 | 619 | ACGGAAGGGAACCAGGUUCUG |
| 6586 | 620 | ACAUCAAUGGUGAAGGGCUUG |
| 6587 | 621 | GUAGAGUUUAGCUCUGCUUUG |

TABLE 9-continued

Results for KIF20A.
Score threshold: 70. Design: siRNA 21 nt.

| SEQ ID NO | siRNA_id | AS Sequence |
|---|---|---|
| 6588 | 622 | UUCAGACCCUGAUUGCUGAUG |
| 6589 | 623 | UCACCACUCUUCUGAUCUUUG |
| 6590 | 624 | UAGAGAGGUGUUAAUGUUUCC |
| 6591 | 625 | AGAGUUUCAUCAUAGGUAGAU |
| 6592 | 626 | CCAGGUUCUGCUUUGACCGGU |
| 6593 | 627 | AAGAGAGCUUCUAGCUCUUCA |
| 6594 | 628 | UCAGGUGUUGGAUGAAGUUGG |
| 6595 | 629 | UUCUACCAUCUCAUUGCAAAU |
| 6596 | 630 | UUCGCAGCCGCAGAGCACAAC |
| 6597 | 631 | CUGGUUGGUACCAAGGCGCUU |
| 6598 | 632 | AUCCCUCCAUCCUUGAUGGUA |
| 6599 | 633 | UGUGCAUAGAAAUCAUAUAAG |
| 6600 | 634 | ACUCCUUGAGGAUAUUUAGUU |
| 6601 | 635 | AGCAAUACAUGCUGCCUUCUU |
| 6602 | 636 | UUCUUCCGAAGGUCCAGUUUC |
| 6603 | 637 | GUUUCUGAAGCUCUGUCCGCA |
| 6604 | 638 | GAUCUGCUUGCUGUCUAGCCA |
| 6605 | 639 | GUCGUUCCAACUCUGAAGGUA |
| 6606 | 640 | AAGGAAUGGUUUCUUCCCUGG |
| 6607 | 641 | GAAGCUGGACUUUCGCAGCCG |
| 6608 | 642 | AAUUCAGACCCUGAUUGCUGA |
| 6609 | 643 | UCCAGGCCUCCUCAGCAUCUU |
| 6610 | 644 | CAGAGCAGUCUGAUAGCAGGU |
| 6611 | 645 | ACAUUUCCUCCAAUAGUUCCU |
| 6612 | 646 | AGCUGGACUUUCGCAGCCGCA |
| 6613 | 647 | AUUUCCUCCUGUCGGAUCUGC |
| 6614 | 648 | ACGGACACAACCCUGAUCUUC |
| 6615 | 649 | AUUGGAGAGCAAGGGCUUCAG |
| 6616 | 650 | UCCUUCAACCGUUCACCACUC |
| 6617 | 651 | UACUUUCACCUUCUCCAUACU |
| 6618 | 652 | UCACCAAGUUUCUGAAGCUCU |
| 6619 | 653 | AGUAGCUGACCCACCUCAGGG |
| 6620 | 654 | UCCUGAAGCUGCUGGGUGGAG |
| 6621 | 655 | UUGCAUCCUGGAUAUAAUUCC |
| 6622 | 656 | AGAGUUUAGCUCUGCUUUGCA |
| 6623 | 657 | CUUCAUUUCCUCCUGUCGGAU |
| 6624 | 658 | ACUGUCGAAGCUGGUGCUGGU |
| 6625 | 659 | AAGUAAAUUUCGAAGGAAUGG |
| 6626 | 660 | UCAGCAAUACAUGCUGCCUUC |
| 6627 | 661 | UUCCCUGGUGGUUGUUGGUUU |
| 6628 | 662 | CUGUCGAAGCUGGUGCUGGUA |
| 6629 | 663 | AGUAAAUUUCGAAGGAAUGGU |
| 6630 | 664 | CUGCAAGAGAGCUUCUAGCUC |
| 6631 | 665 | UCCUGGUUGGUACCAAGGCGC |
| 6632 | 666 | AAGGUCCAGUUUCACUAGCAC |
| 6633 | 667 | UUACAUAGGUGGUUUAUAAUAC |
| 6634 | 668 | AUAGGUAGAUGCACAGGGAUU |
| 6635 | 669 | CUUGAUGAACGAGUGCAGGGA |
| 6636 | 670 | CCAUAUGUAUAGAUGAGCCAG |
| 6637 | 671 | CUGCUGCUUGUCCUCUAGGGA |
| 6638 | 672 | UCUCCAUACUGUCCUCAGAUG |
| 6639 | 673 | CUGGUGCUGGUACCUAUCCGA |
| 6640 | 674 | UGCUCAGCAAUACAUGCUGCC |
| 6641 | 675 | ACAUGGGAGAAACUACGACAU |
| 6642 | 676 | CUACUGCUGGUACACUGACUG |
| 6643 | 677 | AGUGGUAGAGUUUAGCUCUGC |
| 6644 | 678 | UCCGAAGGUCCAGUUUCACUA |
| 6645 | 679 | UGUUCCCGCUGUUGCAUCUGU |
| 6646 | 680 | ACAGGGAUUCACAUUGACAAU |
| 6647 | 681 | UGAUGAACGAGUGCAGGGAUG |
| 6648 | 682 | AGGAAUGGUUUCUUCCCUGGU |
| 6649 | 683 | CUCUUCUGAUCUUUGCAGCGC |
| 6650 | 684 | ACACUCCUCUUCAAGGAAGUG |
| 6651 | 685 | UGUGCCCAUCGAUGACUUGUU |
| 6652 | 686 | UCUGUCCGCAACAGCCUUAUA |
| 6653 | 687 | AAUAGGUCAUAAAGCAGUUCG |
| 6654 | 688 | CUCCUCAGCAUCUUGCACAUG |
| 6655 | 689 | CUUAUGCAACUCUUCAGUGGU |
| 6656 | 690 | GUACACUGACUGAUAGAAGAG |
| 6657 | 691 | UGAAGACUAUGUUCCUUGAUG |
| 6658 | 692 | GAGGUAGAGACGACAGAGCAG |
| 6659 | 693 | CUUGUCCACAUCAAUGGUGAA |
| 6660 | 694 | UGAGUAUUGCAUCCUGGAUAU |

TABLE 9-continued

Results for KIF20A.
Score threshold: 70. Design: siRNA 21 nt.

| SEQ ID NO | siRNA_id | AS Sequence |
|---|---|---|
| 6661 | 695 | CUUCUGAUCUUUGCAGCGCUC |
| 6662 | 696 | UCUAGGGAGGUAGAGACGACA |
| 6663 | 697 | UCCCGCUCCUGAAUCUCUUCU |
| 6664 | 698 | UAGGUAGAUGCACAGGGAUUC |
| 6665 | 699 | CAUUUCCUCCAAUAGUUCCUU |
| 6666 | 700 | AGCAGGGACAGCUUCUUCAUU |
| 6667 | 701 | UCUGCUUUGCACUGCUGUAAU |
| 6668 | 702 | UGUAGAUCUCAAAGAAUGAGA |
| 6669 | 703 | GCUAGUGUCUGAGUAUUGCAU |
| 6670 | 704 | ACUGCACCACUGUUCCCGCUG |
| 6671 | 705 | AAUAAUAUCUUUAAUAUAACU |
| 6672 | 706 | AUCGGACAGCAAGCCCGCUGG |
| 6673 | 707 | UCCUGCUUCCUUCAACCGUUC |
| 6674 | 708 | UAUGUUCCUUGAUGAACGAGU |
| 6675 | 709 | AGGUUGAAGAAGGAUGCCUGU |
| 6676 | 710 | CAAUAUCAUCAUCAAGGCCUG |
| 6677 | 711 | AGACCUAUUUCUUCAGGAGAG |
| 6678 | 712 | GUUGUUCUGCAGUUCAGCCAG |
| 6679 | 713 | CUGCAGUCUGUUGAGCUUUGG |
| 6680 | 714 | AGUACAUCCUUUACCAUCUCC |
| 6681 | 715 | CAUGAAUCCAGUUGAGAUCUU |
| 6682 | 716 | CAUCGGACAGCAAGCCCGCUG |
| 6683 | 717 | CUCCUGUCGGAUCUGCUUGCU |
| 6684 | 718 | AUCUUUGCAGCGCUCUGAGCC |
| 6685 | 719 | AAGGGUCUCCACAUUCUCAAU |
| 6686 | 720 | AAUACGGACACAACCCUGAUC |
| 6687 | 721 | CAUUUCCUCCUGUCGGAUCUG |
| 6688 | 722 | UCACUGCACCACUGUUCCCGC |
| 6689 | 723 | AGUUAGUGACUCCAUAUGUAU |
| 6690 | 724 | AUCUUUCACAUAGGGAUUGCC |
| 6691 | 725 | AGAUGGAACCUGCUGCUUGUC |
| 6692 | 726 | AUAGAAAUCAUAUAAGUAAAU |
| 6693 | 727 | AGAGACCUAUUUCUUCAGGAG |
| 6694 | 728 | UGAGCGUAGGAUCCGGGCAUA |
| 6695 | 729 | UCGUUCCAACUCUGAAGGUAA |
| 6696 | 730 | CAAGGGUCUCCACAUUCUCAA |
| 6697 | 731 | GAACCUGCUGCUUGUCCUCUA |
| 6698 | 732 | AGGCUAUUGAAGAUCAGCGCC |
| 6699 | 733 | CUAGUCGCCGAAGCUGGACUU |
| 6700 | 734 | AUGGGAGAAACUACGACAUCG |
| 6701 | 735 | CUUCCUUCAACCGUUCACCAC |
| 6702 | 736 | AUGCUGCCUUCUUCCGAAGGU |
| 6703 | 737 | CUUCUAACUUCUUGUCCACAU |
| 6704 | 738 | AGAAGAUGCUGUGACUGCGGC |
| 6705 | 739 | UUCCCGCUGUUGCAUCUGUUC |
| 6706 | 740 | CAACCCUGAUCUUCCUGUCGU |
| 6707 | 741 | AAUUUCGAAGGAAUGGUUUCU |
| 6708 | 742 | AGAGAGGUGUUAAUGUUUCCU |
| 6709 | 743 | GAUGUCAUCACAAGUGGUCAA |
| 6710 | 744 | AAGGGCAGCAAUACAGCGGCC |
| 6711 | 745 | AUCAUGCAGGAACGGCUCGG |
| 6712 | 746 | GCAUCCUGGAUAUAAUUCCUG |
| 6713 | 747 | CAACUCUUCAGUGGUAGAGUU |
| 6714 | 748 | UCUGUUCUACCAUCUCAUUGC |
| 6715 | 749 | ACGCCGUGAGCUAGGAUCCG |
| 6716 | 750 | AAUGAGAUCCAGAUGGAGAAG |
| 6717 | 751 | ACAAGCUCUCUCUGCUGAUUG |
| 6718 | 752 | UCUCAAAGAAUGAGAUCCAGA |
| 6719 | 753 | UGGUUGGUACCAAGGCGCUUU |
| 6720 | 754 | AGUAUACUUUCACCUUCUCCA |
| 6721 | 755 | AAAUUUCAUCUCGGAGAUGCA |
| 6722 | 756 | UCUCGGAGAUGCAUCUCCAGC |
| 6723 | 757 | CUGAAGCUCUGUCCGCAACAG |
| 6724 | 758 | GUUAAUGUUUCCUGCUUCCUU |
| 6725 | 759 | UUCGAAGGAAUGGUUUCUUCC |
| 6726 | 760 | CUGAAGGUGUAGGAUCCUGAU |
| 6727 | 761 | AAUACAGCGGCCCAGGGUGUG |
| 6728 | 762 | GUAGGAGCUCCUCUUUGCCAU |
| 6729 | 763 | ACGAAGGGCAGCAAUACAGCG |
| 6730 | 764 | AGAAGCGAAUGUUUGCCGGGA |
| 6731 | 765 | CACUAGCACCAUGUUGUUCUG |
| 6732 | 766 | GAGAAGAUGCUGUGACUGCGG |
| 6733 | 767 | AGACUCACCAAGUUUCUGAAG |

TABLE 9-continued

Results for KIF20A.
Score threshold: 70. Design: siRNA 21 nt.

| SEQ ID NO | siRNA_id | AS Sequence |
|---|---|---|
| 6734 | 768 | AGUAUGAUACUGCUCAGCAAU |
| 6735 | 769 | CAGCCUAGGUCCGAAGACGUG |
| 6736 | 770 | CAUCAUAGGUAGAUGCACAGG |
| 6737 | 771 | CUGCUUGUCCUCUAGGGAGGU |
| 6738 | 772 | ACAGAGCAGUCUGAUAGCAGG |
| 6739 | 773 | UCCGACUUUCGAUGUAGACAC |
| 6740 | 774 | AGGGAGGUAGAGACGACAGAG |
| 6741 | 775 | AGAGCAAGGGCUUCAGAUCAG |
| 6742 | 776 | CAAACAUGGGAGAAACUACGA |
| 6743 | 777 | AUACUGCUCAGCAAUACAUGC |
| 6744 | 778 | ACUCUGAAGGUAACAAGGGCC |
| 6745 | 779 | ACACAACCCUGAUCUUCCUGU |
| 6746 | 780 | CAUCCUUGAUGGUACCUUGAA |
| 6747 | 781 | CACUGCACCACUGUUCCCGCU |
| 6748 | 782 | UGGAGAGCAAGGGCUUCAGAU |
| 6749 | 783 | GUAGACACUCCUCUUCAAGGA |
| 6750 | 784 | CUUGGGUGCUUGUAGAACAAG |
| 6751 | 785 | GUCGGAUCUGCUUGCUGUCUA |
| 6752 | 786 | UAGAAGAGAGCCCAGCAAUGC |
| 6753 | 787 | UCCUUCACAGUUAGGUUGAAG |
| 6754 | 788 | UCUUCCGAAGGUCCAGUUUCA |
| 6755 | 789 | CUCGCAUAGCCGCAAAGUCUG |
| 6756 | 790 | CUAAUAGGUCAUAAAGCAGUU |
| 6757 | 791 | ACUGCGGCUGGAGUUCUGGUU |
| 6758 | 792 | CAUCACAAGUGGUCAAGGCUU |
| 6759 | 793 | CCUCUUCUAACUUCUUGUCCA |
| 6760 | 794 | ACUCAAACAUGGGAGAAACUA |
| 6761 | 795 | AUGCAGGAACGGCCUCGGCCU |
| 6762 | 796 | GGCAACAAGCUCUCUCUGCUG |
| 6763 | 797 | GUCAUAAAGCAGUUCGUUGUA |
| 6764 | 798 | GUCCUCAGAUGGAACCUGCUG |
| 6765 | 799 | GAAGGAAUGGUUUCUUCCCUG |
| 6766 | 800 | CUUCUAGCUCUUCAAUCUUUU |
| 6767 | 801 | UCCUGGAUAUAAUUCCUGAUA |
| 6768 | 802 | UCCCGCGUUGCAUCUGUUCU |
| 6769 | 803 | CAAUACGGACACAACCCUGAU |
| 6770 | 804 | AGUCUGGUCCUGUUUGAUUAA |
| 6771 | 805 | UCACGGAAGGGAACCAGGUUC |
| 6772 | 806 | UGCCGGGACAGGUAGUGGGGC |
| 6773 | 807 | CACUGCUGUAAUUUAGCUUUA |
| 6774 | 808 | UGGAUAUAAUUCCUGAUAUAU |
| 6775 | 809 | AGGAUGCCUGUCCCACUUCUG |
| 6776 | 810 | UGAUAGCAGGUUCUUGCGUAC |
| 6777 | 811 | ACUUCGCAGCCGCAGAGCAC |
| 6778 | 812 | UUCAUUUCCUCCUGUCGGAUC |
| 6779 | 813 | GAAGGGAACCAGGUUCUGCUU |
| 6780 | 814 | UCCUCAGCAUCUUGCACAUGA |
| 6781 | 815 | GAGUACAUCCUUUACCAUCUC |
| 6782 | 816 | CAUCUCGGAGAUGCAUCUCCA |
| 6783 | 817 | GUGAACAAUAAUAUCUUUAAU |
| 6784 | 818 | CUGUCGGAUCUGCUUGCUGUC |
| 6785 | 819 | UCCUCUAGGGAGGUAGAGACG |
| 6786 | 820 | AGAAGGAUGCCUGUCCCACUU |
| 6787 | 821 | GAGUCAACUUGCUGUCACGGA |
| 6788 | 822 | UGUUGGUUUGGUUGCUGAUUU |
| 6789 | 823 | AGAUGCUGUGACUGCGGCUGG |
| 6790 | 824 | AGUGGACAGCUCCUCCUCUUG |
| 6791 | 825 | UGCUGCCUUCUUCCGAAGGUC |
| 6792 | 826 | CAAGGAAGUGGACAGCUCCUC |
| 6793 | 827 | GACAGAGCAGUCUGAUAGCAG |
| 6794 | 828 | CUGUGGACUCAAACAUGGGAG |
| 6795 | 829 | UGAAUCUCUUCUUGGUAAAAA |
| 6796 | 830 | ACCUCCUGAAGCUGCUGGGUG |
| 6797 | 831 | CUCAAGUAUACUUUCACCUUC |
| 6798 | 832 | GCUAUUGAAGAUCAGCGCCAG |
| 6799 | 833 | ACCGUUCACCACUCUUCUGAU |
| 6800 | 834 | UCCUCCUCUUGGAGGCCUCCA |
| 6801 | 835 | UCCUCAGAUGGAACCUGCUGC |
| 6802 | 836 | AUAGGUGGUUAUAAUACAAAA |
| 6803 | 837 | CACAUCAAUGGUGAAGGGCUU |
| 6804 | 838 | CAAGAGAGCUUCUAGCUCUUC |
| 6805 | 839 | GCUUCUAGCUCUUCAAUCUUU |
| 6806 | 840 | UCCGCAACAGCCUUAUAUUCU |

TABLE 9-continued

Results for KIF20A.
Score threshold: 70. Design: siRNA 21 nt.

| SEQ ID NO | siRNA_id | AS Sequence |
|---|---|---|
| 6807 | 841 | UCCCUGGUGGUUGUUGGUUUG |
| 6808 | 842 | CACUCGAGUCAACUUGCUGUC |
| 6809 | 843 | GACUGCUCUUCUCUUUCCCCA |
| 6810 | 844 | GAGAGACUCACCAAGUUUCUG |
| 6811 | 845 | GAGACGACAGAGCAGUCUGAU |
| 6812 | 846 | UUCUUCCCUGGUGGUUGUUGG |
| 6813 | 847 | UCAGUGACUCCUUGAGGAUAU |
| 6814 | 848 | AGGAGAGUAGCUGACCCACCU |
| 6815 | 849 | CUGACUGAUAGAAGAGAGCCC |
| 6816 | 850 | AUCCCGCUCCUGAAUCUCUUC |
| 6817 | 851 | GUAAAUUUCGAAGGAAUGGUU |
| 6818 | 852 | CUUUGCACUGCUGUAAUUUAG |
| 6819 | 853 | AACAAGGGCCUAACCCUCAAG |
| 6820 | 854 | CUCUGCUUUGCACUGCUGUAA |
| 6821 | 855 | CUUGUCAGUGACUCCUUGAGG |
| 6822 | 856 | AUGGAGAUGUCAGCUUCAUUU |
| 6823 | 857 | GAAACUACGACAUCGUCAUCG |
| 6824 | 858 | AGUCUGCCUCUUGCGCUGUUG |
| 6825 | 859 | GAGUUAGUGACUCCAUAUGUA |
| 6826 | 860 | ACAAUAAUAUCUUUAAUAUAA |
| 6827 | 861 | UCCUCUUCAAGGAAGUGGACA |
| 6828 | 862 | GUGUAGAGAGGUGUUAAUGUU |
| 6829 | 863 | CACCAAGUUUCUGAAGCUCUG |
| 6830 | 864 | ACUCACACCUAGUCGCCGAAG |
| 6831 | 865 | GUUCACCACUCUUCUGAUCUU |
| 6832 | 866 | ACCUAUUUCUUCAGGAGAGUA |
| 6833 | 867 | CGAGUCAACUUGCUGUCACGG |
| 6834 | 868 | AGAGACUCACCAAGUUUCUGA |
| 6835 | 869 | ACCUUGAAUCUGUGGGUUUU |
| 6836 | 870 | CACAGUUAGGUUGAAGAAGGA |
| 6837 | 871 | AGGUCAUAAAGCAGUUCGUUG |
| 6838 | 872 | UCCUCUUGGAGGCCUCCAUUU |
| 6839 | 873 | AACAUGGGAGAAACUACGACA |
| 6840 | 874 | GUCUGAGUAUUGCAUCCUGGA |
| 6841 | 875 | CUUCAACCGUUCACCACUCUU |
| 6842 | 876 | CAGUUUCACUAGCACCAUGUU |
| 6843 | 877 | CACCUUCUCCAUACUGUCCUC |
| 6844 | 878 | AACCUUUGUGACCGCCGUAGG |
| 6845 | 879 | CAUAGCCGCAAAGUCUGCCUC |
| 6846 | 880 | CUUUCACAUAGGGAUUGCCAU |
| 6847 | 881 | AACCCUCAAGUAUACUUUCAC |
| 6848 | 882 | CAUCUGUUCUACCAUCUCAUU |
| 6849 | 883 | GUCUGAUAGCAGGUUCUUGCG |
| 6850 | 884 | AUGGAGAAGCGAAUGUUUGCC |
| 6851 | 885 | GUCUCCACAUUCUCAAUACGG |
| 6852 | 886 | AUUACAUAGGUGGUUAUAAUA |
| 6853 | 887 | UGCGGCUGGAGUUCUGGUUGA |
| 6854 | 888 | CAAGUGGUCAAGGCUUGACGA |
| 6855 | 889 | UGAUCUUCCUGUCGUUCCAAC |
| 6856 | 890 | ACCUAGUCGCCGAAGCUGGAC |
| 6857 | 891 | CUCCUUCACAGUUAGGUUGAA |
| 6858 | 892 | AGGAUCCUGAUUGAGAAGAUG |
| 6859 | 893 | CGUCAUCGGACAGCAAGCCCG |
| 6860 | 894 | AUCUGCAGCUGUGGACUCAAA |
| 6861 | 895 | UCACUAGCACCAUGUUGUUCU |
| 6862 | 896 | UCAUCCCGCUCCUGAAUCUCU |
| 6863 | 897 | UCUGAAGCUCUGUCCGCAACA |
| 6864 | 898 | GCAUCUGUUCUACCAUCUCAU |
| 6865 | 899 | AGAUGCACAGGGAUUCACAUU |
| 6866 | 900 | AGCUCUCUCUGCUGAUUGGAG |
| 6867 | 901 | GUUUAGCUCUGCUUUGCACUG |
| 6868 | 902 | GAGUGACAGCUCGCUGAUCUU |
| 6869 | 903 | AGGUAACAAGGGCCUAACCCU |
| 6870 | 904 | GAAGAAACCUUGGAACACUCG |
| 6871 | 905 | AUAUAUGGUAAAGCAUAAAAG |
| 6872 | 906 | GAGAUCCAGAUGGAGAAGCGA |
| 6873 | 907 | CAUACAUUCCUCCAAUAGUU |
| 6874 | 908 | ACCACUGUUCCCGCUGUUGCA |
| 6875 | 909 | CUCACCAAGUUUCUGAAGCUC |
| 6876 | 910 | AUCUCAUUGCAAAUUUCAUCU |
| 6877 | 911 | CUGUUCCCGCUGUUGCAUCUG |
| 6878 | 912 | GAGAAACUACGACAUCGUCAU |
| 6879 | 913 | AGCACCAUGUUGUUCUGCAGU |

TABLE 9-continued

Results for KIF20A.
Score threshold: 70. Design: siRNA 21 nt.

| SEQ ID NO | siRNA_id | AS Sequence |
|---|---|---|
| 6880 | 914 | AUACGGACACAACCCUGAUCU |
| 6881 | 915 | AAGAGAGCCCAGCAAUGCCAC |
| 6882 | 916 | CUCGAGUCAACUUGCUGUCAC |
| 6883 | 917 | AAGGAUGCCUGUCCCACUUCU |
| 6884 | 918 | UUGCGACAUGACGGCAGGGGC |
| 6885 | 919 | GAGAGGUGUUAAUGUUUCCUG |
| 6886 | 920 | AAUCAUAUAAGUAAAUAAAAA |
| 6887 | 921 | CAAUCAUGCAGGAACGGCCUC |
| 6888 | 922 | GGGAUUCACAUUGACAAUCAU |
| 6889 | 923 | AGGUUCUUGCGUACCACAGAC |
| 6890 | 924 | UCAUUUCCUCCUGUCGGAUCU |
| 6891 | 925 | CAUCCCGCUCCUGAAUCUCUU |
| 6892 | 926 | GUUCUGCUUUGACCGGUUCUG |
| 6893 | 927 | UGCUACAUUUGGAAUUCAAUA |
| 6894 | 928 | CUUGUAGAACAAGGGUCUCCA |
| 6895 | 929 | AGGUAGAGACGACAGAGCAGU |
| 6896 | 930 | UGCUGUCACGGAAGGGAACCA |
| 6897 | 931 | CUUUGACCGGUUCUGCUGGUU |
| 6898 | 932 | GAAGAUGCUGUGACUGCGGCU |
| 6899 | 933 | CAAGUAUACUUUCACCUUCUC |
| 6900 | 934 | GGGUGCUUGUAGAACAAGGGU |
| 6901 | 935 | CACCUAGUCGCCGAAGCUGGA |
| 6902 | 936 | AGCCGCAAAGUCUGCCUCUUG |
| 6903 | 937 | GGUACCUAUCCGACUUUCGAU |
| 6904 | 938 | CGACUUUCGAUGUAGACACUC |
| 6905 | 939 | GAUGCUGUGACUGCGGCUGGA |
| 6906 | 940 | CAGACCCUGAUUGCUGAUGGG |
| 6907 | 941 | AUACUUUCACCUUCUCCAUAC |
| 6908 | 942 | AGGGCUUCAGAUCAGGUGUUG |
| 6909 | 943 | AGAUCCAGAUGGAGAAGCGAA |
| 6910 | 944 | ACUUGCUGUCACGGAAGGGAA |
| 6911 | 945 | AGAGGUGUUAAUGUUUCCUGC |
| 6912 | 946 | GAAACCUUGGAACACUCGAGU |
| 6913 | 947 | CAAAGCUCUGGUUCUUACGAC |
| 6914 | 948 | CUCAUUGGAGAGCAAGGGCUU |
| 6915 | 949 | CAUCUUGCACAUGAAUCCAGU |

TABLE 9-continued

Results for KIF20A.
Score threshold: 70. Design: siRNA 21 nt.

| SEQ ID NO | siRNA_id | AS Sequence |
|---|---|---|
| 6916 | 950 | UGAGUACAUCCUUUACCAUCU |
| 6917 | 951 | UGUGGACUCAAACAUGGGAGA |
| 6918 | 952 | CUGCUGAUUGGAGAGACUCAC |
| 6919 | 953 | ACGACAUCGUCAUCGGACAGC |
| 6920 | 954 | CAGUUCGUUGUAGAUCUCAAA |
| 6921 | 955 | CUCCUUGAGGAUAUUUAGUUU |
| 6922 | 956 | GAGAAGCGAAUGUUUGCCGGG |
| 6923 | 957 | AGAAAGGAUCCCUUGCGACAU |
| 6924 | 958 | CGACAGAGCAGUCUGAUAGCA |
| 6925 | 959 | UGUAGACACUCCUCUUCAAGG |
| 6926 | 960 | CGAAGGAAUGGUUUCUUCCCU |
| 6927 | 961 | UGGAGGCCUCCAUUUAGCAGG |
| 6928 | 962 | AUGUUUGCCGGGACAGGUAGU |
| 6929 | 963 | GAUCACAGAGUGACAGCUCGC |
| 6930 | 964 | CCGCUCCUGAAUCUCUUCUUG |
| 6931 | 965 | AGCAAUACAGCGGCCCAGGGU |
| 6932 | 966 | AAAGGAUCCCUUGCGACAUGA |
| 6933 | 967 | UCACAGUUAGGUUGAAGAAGG |
| 6934 | 968 | AGUUGAGAUCUUUCACAUAGG |
| 6935 | 969 | AUUGACAAUCAUGCAGGAACG |
| 6936 | 970 | CUGAUACUUAUGCAACUCUUC |
| 6937 | 971 | ACUCUUCAGUGGUAGAGUUUA |
| 6938 | 972 | CCUGAUUGAGAAGAUGCUGUG |
| 6939 | 973 | UGAAUCCAGUUGAGAUCUUUC |
| 6940 | 974 | GCAAGAGAGCUUCUAGCUCUU |
| 6941 | 975 | CCUCAAGUAUACUUUCACCUU |
| 6942 | 976 | AAGCUCUGGUUCUUACGACCC |
| 6943 | 977 | GACUGAUAGAAGAGAGCCCAG |
| 6944 | 978 | AAAUCUAUAAGUAAAUAAAA |
| 6945 | 979 | CUGGUUCUUACGACCCACUUU |
| 6946 | 980 | CGAAGGGCAGCAAUACAGCGG |
| 6947 | 981 | CUUCACAGUUAGGUUGAAGAA |
| 6948 | 982 | AGCAGUCUGAUAGCAGGUUCU |
| 6949 | 983 | GUAGAGACGACAGAGCAGUCU |
| 6950 | 984 | GGAGUUUCAACACAGUAUGAU |
| 6951 | 985 | UGCCCAUCGAUGACUUGUUUC |
| 6952 | 986 | UCCACAUUCUCAAUACGGACA |

TABLE 9-continued

Results for KIF20A.
Score threshold: 70. Design: siRNA 21 nt.

| SEQ ID NO | siRNA_id | AS Sequence |
|---|---|---|
| 6953 | 987 | ACCUGAAGACUAUGUUCCUUG |
| 6954 | 988 | UGUCAUCACAAGUGGUCAAGG |
| 6955 | 989 | CCUUGGAGUUUCAACACAGUA |
| 6956 | 990 | CUGAGUAUUGCAUCCUGGAUA |
| 6957 | 991 | CUUUGAGUACAUCCUUUACCA |
| 6958 | 992 | GUGAGCGUAGGAUCCGGCAU |
| 6959 | 993 | GUACAUCCUUUACCAUCUCCU |
| 6960 | 994 | CUUCUUCCGAAGGUCCAGUUU |
| 6961 | 995 | GGUACCUUGAAUCGUGUGGGU |
| 6962 | 996 | AUCCGGGCAUAAGGGCUGCAG |
| 6963 | 997 | CUUGGAGUUUCAACACAGUAU |
| 6964 | 998 | AAGGUAACAAGGGCCUAACCC |
| 6965 | 999 | GUGCUGGUACCUAUCCGACUU |
| 6966 | 1000 | UUACCUCAUUGGAGAGCAAGG |
| 6967 | 1001 | UGAGAUCCAGAUGGAGAAGCG |
| 6968 | 1002 | CUGGAGUUCUGGUUGAGGUGG |
| 6969 | 1003 | CAGCUGUGGACUCAAACAUGG |
| 6970 | 1004 | CUGAGUUAGUGACUCCAUAUG |
| 6971 | 1005 | ACCAUCUCCUUCACAGUUAGG |
| 6972 | 1006 | GACUCCAUAUGUAUAGAUGAG |
| 6973 | 1007 | GUUGUUGGUUUGGUUGCUGAU |
| 6974 | 1008 | GCAACAAGCUCUCUCUGCUGA |

TABLE 10

Results for LTB.
Score threshold: 70. Design: siRNA 21 nt.

| SEQ ID NO | siRNA_id | siRNA guide strand/ AS Sequence |
|---|---|---|
| 6975 | 1 | UUAUCGGCAGCACUGAAGCUU |
| 6976 | 2 | UGUUCCUUCGUCGUCUCCCAG |
| 6977 | 3 | UCAAUUUCCAAACAGUCUCCU |
| 6978 | 4 | UUUCCAAACAGUCUCCUACAU |
| 6979 | 5 | UUGACGUACACCCUCUCGCCC |
| 6980 | 6 | UUUAUCGGCAGCACUGAAGCU |
| 6981 | 7 | UUCUGAAACCCAGUCCUCCCU |
| 6982 | 8 | UAAUAGAGGCCGUCCUGCGGG |

TABLE 10-continued

Results for LTB.
Score threshold: 70. Design: siRNA 21 nt.

| SEQ ID NO | siRNA_id | siRNA guide strand/ AS Sequence |
|---|---|---|
| 6983 | 9 | UCGUGUACCAGAGAGGCCCGU |
| 6984 | 10 | UACAGAGAGCUGCGCAGCGUG |
| 6985 | 11 | UCCUUCGUCGUCUCCCAGCCU |
| 6986 | 12 | UCGAGCAGCAGCUCGGGAGUG |
| 6987 | 13 | UCUGAAACCCAGUCCUCCCUG |
| 6988 | 14 | UUCACGCACUCGCACCACGCA |
| 6989 | 15 | UUCCAAACAGUCUCCUACAUU |
| 6990 | 16 | AAGAAGGUCUUCCCUCUCGCG |
| 6991 | 17 | AUAUUCACGCACUCGCACCAC |
| 6992 | 18 | UCCAGCACUGGAGUCACCGUC |
| 6993 | 19 | ACUGAUGUUGACGUACACCCU |
| 6994 | 20 | UCGCGAAGUCCACCAUAUCGG |
| 6995 | 21 | UAGCCGACGAGACAGUAGAGG |
| 6996 | 22 | UCACGCACUCGCACCACGCAC |
| 6997 | 23 | AAGCUUUCCAUUCUUUAUUUU |
| 6998 | 24 | UAUCGGCAGCACUGAAGCUUU |
| 6999 | 25 | AUGUUGACGUACACCCUCUCG |
| 7000 | 26 | AGAAGGUCUUCCCUCUCGCGA |
| 7001 | 27 | AACAAGGUCACCAGAGAAGUG |
| 7002 | 28 | AACGCCUGUUCCUUCGUCGUC |
| 7003 | 29 | UCGUCUCCCAGCCUAGCCCCU |
| 7004 | 30 | UCGGCGUCCGAGAACUGCGUC |
| 7005 | 31 | AAUAUUCACGCACUCGCACCA |
| 7006 | 32 | UCGUCAGAAACGCCUGUUCCU |
| 7007 | 33 | UACCAGAGAGGCCCGUACCCU |
| 7008 | 34 | ACUGGAGUCACCGUCUCGGCG |
| 7009 | 35 | UAUGAGGUGGGCAGCUGGGAG |
| 7010 | 36 | UGAUGUUGACGUACACCCUCU |
| 7011 | 37 | AUCAAUUUCCAAACAGUCUCC |
| 7012 | 38 | UGACGUACACCCUCUCGCCCC |
| 7013 | 39 | AGUAGAGGUAAUAGAGGCCGU |
| 7014 | 40 | UGAAGCUUUCCAUUCUUUAUU |
| 7015 | 41 | CUGAUGUUGACGUACACCCUC |
| 7016 | 42 | UCCCGCUCGUCAGAAACGCCU |
| 7017 | 43 | AGCACUGGAGUCACCGUCUCG |
| 7018 | 44 | CAAUUUCCAAACAGUCUCCUA |
| 7019 | 45 | AAACGCCUGUUCCUUCGUCGU |

TABLE 10-continued

Results for LTB.
Score threshold: 70. Design: siRNA 21 nt.

| SEQ ID NO | siRNA_id | siRNA guide strand/ AS Sequence |
|---|---|---|
| 7020 | 46 | UAUUCACGCACUCGCACCACG |
| 7021 | 47 | AUAGAGGCCGUCCUGCGGGAG |
| 7022 | 48 | GACAGUGAUAGGCACCGCCAG |
| 7023 | 49 | AGCUUCUGAAACCCAGUCCUC |
| 7024 | 50 | AGCAACAAGGUCACCAGAGAA |
| 7025 | 51 | UUCCUUCGUCGUCUCCCAGCC |
| 7026 | 52 | UCCGAGAACUGCGUCCCGCUC |
| 7027 | 53 | AGAGCUGCGCAGCGUGACCGA |
| 7028 | 54 | CUGCGCAGCGUGACCGAGCGG |
| 7029 | 55 | AAUAGAGGCCGUCCUGCGGGA |
| 7030 | 56 | UGAAACCCAGUCCUCCCUGAU |
| 7031 | 57 | UGUUGACGUACACCCUCUCGC |
| 7032 | 58 | ACCCAGUCCUCCCUGAUCCUG |
| 7033 | 59 | ACAAGGUCACCAGAGAAGUGG |
| 7034 | 60 | UGGAGUCACCGUCUCGGCGCC |
| 7035 | 61 | AUCGGCAGCACUGAAGCUUUC |
| 7036 | 62 | AAUUUCCAAACAGUCUCCUAC |
| 7037 | 63 | AGAAACGCCUGUUCCUUCGUC |
| 7038 | 64 | UUCAGCGGAGCGCCUAUGAGG |
| 7039 | 65 | UCACCGUCUCGGCGCCCUCGA |
| 7040 | 66 | AACUGCGUCCCGCUCGUCAGA |
| 7041 | 67 | AUUCACGCACUCGCACCACGC |
| 7042 | 68 | AAAGAAGGUCUUCCCUCUCGC |
| 7043 | 69 | GUACAGAGAGCUGCGCAGCGU |
| 7044 | 70 | AGACAGUAGAGGUAAUAGAGG |
| 7045 | 71 | CAGUAGAGGUAAUAGAGGCCG |
| 7046 | 72 | UCCAAACAGUCUCCUACAUUU |
| 7047 | 73 | CAAACAGUCUCCUACAUUUUU |
| 7048 | 74 | GUAAUAGAGGCCGUCCUGCGG |
| 7049 | 75 | UUCGUCGUCUCCCAGCCUAGC |
| 7050 | 76 | AAGGUCUUCCCUCUCGCGAAG |
| 7051 | 77 | CUGUUCCUUCGUCGUCUCCCA |
| 7052 | 78 | CCUUCGUCGUCUCCCAGCCUA |
| 7053 | 79 | UGACUGAUGUUGACGUACACC |
| 7054 | 80 | UGCACCAGGCCGCCGAACCCC |
| 7055 | 81 | GAGGUAAUAGAGGCCGUCCUG |
| 7056 | 82 | UCUUCCCUCUCGCGAAGUCCA |
| 7057 | 83 | AGAGGUAAUAGAGGCCGUCCU |
| 7058 | 84 | AUUUCCAAACAGUCUCCUACA |
| 7059 | 85 | ACAGUAGAGGUAAUAGAGGCC |
| 7060 | 86 | CAGCUUCUGAAACCCAGUCCU |
| 7061 | 87 | AACCCAGUCCUCCCUGAUCCU |
| 7062 | 88 | UCCGGAGCUGCACCAGGCCGC |
| 7063 | 89 | UCAGAAACGCCUGUUCCUUCG |
| 7064 | 90 | UCGUCGUCUCCCAGCCUAGCC |
| 7065 | 91 | CAGCACUGGAGUCACCGUCUC |
| 7066 | 92 | CAGUCCUCCCUGAUCCUGGGG |
| 7067 | 93 | ACUGAAGCUUUCCAUUCUUUA |
| 7068 | 94 | UGCGCAGCGUGACCGAGCGGC |
| 7069 | 95 | UCAGCGGAGCGCCUAUGAGGU |
| 7070 | 96 | UCCCUCUCGCGAAGUCCACCA |
| 7071 | 97 | AGCACUGAAGCUUUCCAUUCU |
| 7072 | 98 | UAGAGGUAAUAGAGGCCGUCC |
| 7073 | 99 | ACUCGCACCACGCACUCAUAU |
| 7074 | 100 | CUCGGCGUCCGAGAACUGCGU |
| 7075 | 101 | AGGACAGUGAUAGGCACCGCC |
| 7076 | 102 | GCGAAGUCCACCAUAUCGGGG |
| 7077 | 103 | GAGCUGCGCAGCGUGACCGAG |
| 7078 | 104 | GAGAACUGCGUCCCGCUCGUC |
| 7079 | 105 | ACGCACUCGCACCACGCACUC |
| 7080 | 106 | GCACUGAAGCUUUCCAUUCUU |
| 7081 | 107 | ACAGCUAGCAGGAGGGAACCC |
| 7082 | 108 | ACGCCUGUUCCUUCGUCGUCU |
| 7083 | 109 | CACCACGCACUCAUAUUCCCU |
| 7084 | 110 | GUAGAGGUAAUAGAGGCCGUC |
| 7085 | 111 | ACAGAGAGCUGCGCAGCGUGA |
| 7086 | 112 | GAGACAGUAGAGGUAAUAGAG |
| 7087 | 113 | ACUGCGUCCCGCUCGUCAGAA |
| 7088 | 114 | CGCGAAGUCCACCAUAUCGGG |
| 7089 | 115 | GUAGCCGACGAGACAGUAGAG |
| 7090 | 116 | CACUGAAGCUUUCCAUUCUUU |
| 7091 | 117 | UCGGCAGCACUGAAGCUUUCC |

TABLE 11

GalNAC-siRNA conjugates.

| SEQ ID NO | siRNA_id | Passenger strand (sense) | SEQ ID NO | guide strand (antisense) |
|---|---|---|---|---|
| 7092 | Mfap4.1356 | GCUACUGCUCAACUCUGAA | 7141 | UUCAGAGUUGAGCAGUAGCCG |
| 7093 | Mfap4.760 | GCUUCUAUUACUCCCUCAA | 7142 | UUGAGGGAGUAAUAGAAGCCU |
| 7094 | Grhpr.361 | GACAGAUGCCACUGCAGAA | 7143 | UUCUGCAGUGGCAUCUGUCAG |
| 7095 | lftg1.698 | CGACAUUGACUGCCUCUAA | 7144 | UUAGAGGCAGUCAAUGUCGUG |
| 7096 | ltfg1.680 | CACUGAUUAUGGACUUCAA | 7145 | UUGAAGUCCAUAAUCAGUGGU |
| 7146 | Mfap4.1356 modified | 5'-cscsaGfcUfaCfuGfcUfcAfaCfuCfuGfaAfs(NHC6)(GalNAc3)-3' | 7151 | 5'-UfsUfscAfgAfgUfuGfaGfcAfgUfaGfcsdTsdT-3' |
| 7147 | Mfap4.760 modified | 5'-cscsaGfcUfuCfuAfuUfaCfuCfcCfuCfaAfs(NHC6)(GalNAc3)-3' | 7152 | 5'-UfsUfsgAfgGfgAfgUfaAfuAfgAfaGfcsdTsdT-3' |
| 7148 | Grhpr.361 modified | 5'-cscsaGfaCfaGfaUfgCfcAfcUfgCfaGfaAfs(NHC6)(GalNAc3)-3' | 7153 | 5'-UfsUfscUfgCfaGfuGfgCfaUfcUfgUfcsdTsdT-3' |
| 7149 | lftg1.698 modified | 5'-cscsaCfgAfcAfuUfgAfcUfgCfcUfcUfaAfs(NHC6)(GalNAc3)-3' | 7154 | 5'-UfsUfsaGfaGfgCfaGfuCfaAfuGfuCfgsdTsdT-3' |
| 7150 | ltfg1.680 modified | 5'-cscsaCfaCfuGfaUfuAfuGfgAfcUfuCfaAfs(NHC6)(GalNAc3)-3' | 7155 | 5'-UfsUfsgAfaGfuCfcAfuAfaUfcAfgUfgsdTsdT-3' | n: 2'-O-methyl residues
Nf: 2'-Fluoro residues
s: phosphorothioate backbone modification
dN: DNA residue
(NHC6): Aminohexyl linker
(GalNAc3): Trinatennary GalNAc cluster

TABLE 12

Human shRNAs sequences (sense-loop-antisense sequences)

| SEQ ID NO: | shRNA-id | Nucleic acid sequence |
|---|---|---|
| 7097 | huMfap4.1602 | TGCTGTTGACAGTGAGCGATAGGGACTGAAGGTCTCAATATAGTGAAGCCACAGATGTATATTGAGACCTTCAGTCCCTACTGCCTACTGCCTCGGA |
| 7098 | huMfap4.1603 | TGCTGTTGACAGTGAGCGCAGGGACTGAAGGTCTCAATAATAGTGAAGCCACAGATGTATTATTGAGACCTTCAGTCCCTATGCCTACTGCCTCGGA |
| 7099 | huMfap4.1642 | TGCTGTTGACAGTGAGCGAAACTGGCTTCATACACACAAATAGTGAAGCCACAGATGTATTTGTGTGTATGAAGCCAGTTCTGCCTACTGCCTCGGA |
| 7100 | huMfap4.1812 | TGCTGTTGACAGTGAGCGCCAGTGTAATAATAACATAATATAGTGAAGCCACAGATGTATATTATGTTATTATTACACTGTTGCCTACTGCCTCGGA |
| 7101 | huMfap4.318 | TGCTGTTGACAGTGAGCGACAGAAGAGATTCAATGGCTCATAGTGAAGCCACAGATGTATGAGCCATTGAATCTCTTCTGGTGCCTACTGCCTCGGA |
| 7102 | huMfap4.350 | TGCTGTTGACAGTGAGCGCCCGCGGCTGGAATGACTACAATAGTGAAGCCACAGATGTATTGTAGTCATTCCAGCCGCGGATGCCTACTGCCTCGGA |
| 7103 | huGrhpr.1125 | TGCTGTTGACAGTGAGCGAAAGGTGTGATTCTCTGAGGAATAGTGAAGCCACAGATGTATTCCTCAGAGAATCACACCTTCTGCCTACTGCCTCGGA |
| 7104 | huGrhpr.1172 | TGCTGTTGACAGTGAGCGCCACATTGGTGTTGGACACATTTAGTGAAGCCACAGATGTAAATGTGTCCAACACCAATGTGATGCCTACTGCCTCGGA |
| 7105 | huGrhpr.626 | TGCTGTTGACAGTGAGCGCTCCAGGCAGAGTTTGTGTCTATAGTGAAGCCACAGATGTATAGACACAAACTCTGCCTGGAATGCCTACTGCCTCGGA |
| 7106 | huGrhpr.750 | TGCTGTTGACAGTGAGCGCAACAGCTGTGTTCATCAACATTAGTGAAGCCACAGATGTAATGTTGATGAACACAGCTGTTTTGCCTACTGCCTCGGA |

TABLE 12-continued

Human shRNAs sequences
(sense-loop-antisense sequences)

| SEQ ID NO: | shRNA-id | Nucleic acid sequence |
|---|---|---|
| 7107 | huGrhpr.752 | TGCTGTTGACAGTGAGCGCCAGCTG<br>TGTTCATCAACATCATAGTGAAGCC<br>ACAGATGTATGATGTTGATGAACAC<br>AGCTGTTGCCTACTGCCTCGGA |
| 7108 | huGrhpr.954 | TGCTGTTGACAGTGAGCGACATGTC<br>CTTGTTGGCAGCTAATAGTGAAGCC<br>ACAGATGTATTAGCTGCCAACAAGG<br>ACATGGTGCCTACTGCCTCGGA |
| 7109 | huItfg1.1364 | TGCTGTTGACAGTGAGCGAAAGCAG<br>ATGCTTATTTTGTTATAGTGAAGCC<br>ACAGATGTATAACAAAATAAGCATC<br>TGCTTCTGCCTACTGCCTCGGA |
| 7110 | huItfg1.1683 | TGCTGTTGACAGTGAGCGACCAGCT<br>AATTGTCATTCCATATAGTGAAGCC<br>ACAGATGTATATGGAATGACAATTA<br>GCTGGGTGCCTACTGCCTCGGA |
| 7111 | huItfg1.2162 | TGCTGTTGACAGTGAGCGATCCAGT<br>GTTTGTGTATTTATATAGTGAAGCC<br>ACAGATGTATATAAATACACAAACA<br>CTGGAGTGCCTACTGCCTCGGA |
| 7112 | huItfg1.2163 | TGCTGTTGACAGTGAGCGACCCAGTG<br>TTTGTGTATTTATAATAGTGAAGCC<br>ACAGATGTATTATAAATACACAAAC<br>ACTGGATGCCTACTGCCTCGGA |
| 7113 | huItfg1.641 | TGCTGTTGACAGTGAGCGACAGCAT<br>TGACCACTACAAGTATAGTGAAGCC<br>ACAGATGTATACTTGTAGTGGTCAA<br>TGCTGGTGCCTACTGCCTCGGA |
| 7114 | huItfg1.971 | TGCTGTTGACAGTGAGCGATCCTAC<br>AAGATTTCAGCAATATAGTGAAGCC<br>ACAGATGTATATTGCTGAAATCTTG<br>TAGGACTGCCTACTGCCTCGGA |

TABLE 13

Mouse shRNA sequences
(sense-loop-antisense sequences)

| SEQ ID NO | shRNA_id | Nucleic acid sequence |
|---|---|---|
| 7115 | Mfap4.1073 | TGCTGTTGACAGTGAGCGAAAAGCC<br>AGAAGCTACCTTCTATAGTGAAGCC<br>ACAGATGTATAGAAGGTAGCTTCTG<br>GCTTTCTGCCTACTGCCTCGGA |
| 7116 | Mfap4.1118 | TGCTGTTGACAGTGAGCGCCAGCAG<br>TTTCCTTACTGCAGATAGTGAAGCC<br>ACAGATGTATCTGCAGTAAGGAAAC<br>TGCTGATGCCTACTGCCTCGGA |
| 7117 | Mfap4.1321 | TGCTGTTGACAGTGAGCGCTCCCTC<br>AAAATTCACCACCAATAGTGAAGCC<br>ACAGATGTATTGGTGGTGAATTTTG<br>AGGGATTGCCTACTGCCTCGGA |
| 7118 | Mfap4.1356 | TGCTGTTGACAGTGAGCGCCGGCTA<br>CTGCTCAACTCTGAATAGTGAAGCC<br>ACAGATGTATTCAGAGTTGAGCAGT<br>AGCCGTTGCCTACTGCCTCGGA |

TABLE 13-continued

Mouse shRNA sequences
(sense-loop-antisense sequences)

| SEQ ID NO | shRNA_id | Nucleic acid sequence |
|---|---|---|
| 7119 | Mfap4.274 | TGCTGTTGACAGTGAGCGACAAGTG<br>GACGGTTTTCCAGAATAGTGAAGCC<br>ACAGATGTATTCTGGAAAACCGTCC<br>ACTTGCTGCCTACTGCCTCGGA |
| 7120 | Mfap4.760 | TGCTGTTGACAGTGAGCGCAGGCTT<br>CTATTACTCCCTCAATAGTGAAGCC<br>ACAGATGTATTGAGGGAGTAATAGA<br>AGCCTTTGCCTACTGCCTCGGA |
| 7121 | Grhpr.1009 | TGCTGTTGACAGTGAGCGACCCAGC<br>GAACTCAAGCTGTAATAGTGAAGCC<br>ACAGATGTATTACAGCTTGAGTTCG<br>CTGGGCTGCCTACTGCCTCGGA |
| 7122 | Grhpr.1187 | TGCTGTTGACAGTGAGCGCTGCCAA<br>AAGCCTGTAATTCTATAGTGAAGCC<br>ACAGATGTATAGAATTACAGGCTTT<br>TGGCAATGCCTACTGCCTCGGA |
| 7123 | Grhpr.1193 | TGCTGTTGACAGTGAGCGCAAGCCT<br>GTAATTCTAGCATTATAGTGAAGCC<br>ACAGATGTATAATGCTAGAATTACA<br>GGCTTTTGCCTACTGCCTCGGA |
| 7124 | Grhpr.720 | TGCTGTTGACAGTGAGCGACAGCAA<br>GGATTTCTTCCAGAATAGTGAAGCC<br>ACAGATGTATTCTGGAAGAAATCCT<br>TGCTGCTGCCTACTGCCTCGGA |
| 7125 | Grhpr.361 | TGCTGTTGACAGTGAGCGACTGACA<br>GATGCCACTGCAGAATAGTGAAGCC<br>ACAGATGTATTCTGCAGTGGCATCT<br>GTCAGGTGCCTACTGCCTCGGA |
| 7126 | Grhpr.787 | TGCTGTTGACAGTGAGCGCCAGCAG<br>AGGAGATGTGGTAAATAGTGAAGCC<br>ACAGATGTATTTACCACATCTCCTC<br>TGCTGATGCCTACTGCCTCGGA |
| 7127 | Grhpr.736 | TGCTGTTGACAGTGAGCGACAGCAA<br>GGATTTCTTCCAGAATAGTGAAGCC<br>ACAGATGTATTCTGGAAGAAATCCT<br>TGCTGCTGCCTACTGCCTCGGA |
| 7128 | Grhpr.1024 | TGCTGTTGACAGTGAGCGCGCCCAG<br>CGAACTCAAGCTGTATAGTGAAGCC<br>ACAGATGTATACAGCTTGAGTTCGC<br>TGGGCATGCCTACTGCCTCGGA |
| 7129 | Grhpr.1025 | TGCTGTTGACAGTGAGCGACCCAGC<br>GAACTCAAGCTGTAATAGTGAAGCC<br>ACAGATGTATTACAGCTTGAGTTCG<br>CTGGGCTGCCTACTGCCTCGGA |
| 7130 | Iftg1.698 | TGCTGTTGACAGTGAGCGCCACGAC<br>ATTGACTGCCTCTAATAGTGAAGCC<br>ACAGATGTATTAGAGGCAGTCAATG<br>TCGTGATGCCTACTGCCTCGGA |
| 7131 | Itfg1.376 | TGCTGTTGACAGTGAGCGCGCCATC<br>CATACACTCAAAAATAGTGAAGCC<br>ACAGATGTATTTTTGAGTGTATGG<br>ATGGCATGCCTACTGCCTCGGA |
| 7132 | Itfg1.448 | TGCTGTTGACAGTGAGCGCGACGCC<br>ATAGTTGCCACCTTATAGTGAAGCC<br>ACAGATGTATAAGGTGGCAACTATG<br>GCGTCTTGCCTACTGCCTCGGA |

TABLE 13-continued

Mouse shRNA sequences
(sense-loop-antisense sequences)

| SEQ ID NO | shRNA_id | Nucleic acid sequence |
|---|---|---|
| 7133 | Itfg1.694 | TGCTGTTGACAGTGAGCGCGAGGCA GATGCTTACTTTGTATAGTGAAGCC ACAGATGTATACAAAGTAAGCATCT GCCTCATGCCTACTGCCTCGGA |
| 7134 | Itfg1.2450 | TGCTGTTGACAGTGAGCGACCAGAT AAAGTTATTCAAGTATAGTGAAGCC ACAGATGTATACTTGAATAACTTTA TCTGGCTGCCTACTGCCTCGGA |
| 7135 | Itfg1.2451 | TGCTGTTGACAGTGAGCGACAGATA AAGTTATTCAAGTAATAGTGAAGCC ACAGATGTATACTTGAATAACTTT ATCTGGTGCCTACTGCCTCGGA |
| 7136 | Itfg1.2802 | TGCTGTTGACAGTGAGCGCTGGATT GTCACCGAAGACATATAGTGAAGCC ACAGATGTATATGTCTTCGGTGACA ATCCATTGCCTACTGCCTCGGA |
| 7137 | Itfg1.2921 | TGCTGTTGACAGTGAGCGCAAGCTG GTATTTGAATACTAATAGTGAAGCC ACAGATGTATTAGTATTCAAATACC AGCTTTTGCCTACTGCCTCGGA |
| 7138 | Itfg1.680 | TGCTGTTGACAGTGAGCGCACCACT GATTATGGACTTCAATAGTGAAGCC ACAGATGTATTGAAGTCCATAATCA GTGGTTTGCCTACTGCCTCGGA |
| 7139 | Itfg1.875 | TGCTGTTGACAGTGAGCGCCACGAC ATTGACTGCCTCTAATAGTGAAGCC ACAGATGTATTAGAGGCAGTCAATG TCGTGATGCCTACTGCCTCGGA |
| 7140 | Itfg1.503 | TGCTGTTGACAGTGAGCGCACCACT GATTATGGACTTCAATAGTGAAGCC ACAGATGTATTGAAGTCCATAATCA GTGGTTTGCCTACTGCCTCGGA |

TABLE 14

Target sequences.

| SEQ ID NO: | Description | Sequence |
|---|---|---|
| 7156 | Human MFAP4 isoform 1 (UniProtKB: P55083-1, v2) | MKALLALPLLLLLSTPPCAPQVSGIRGDALERFCLQQPLDCDDIYAQGYQSDGVYLIYPSGPSVPVP VFCDMTTEGGKWTVFQKRFNGSVSFFRGWNDYKLGFGRADGEYWLGLQNMHLLTLKQKYELRVDLEDFE NNTAYAKYADFSISPNAVSAEEDGYTLFVAGFEDGGAGDSLSYHSGQKFSTFDRDQDLFVQNCAALSS GAFWFRSCHFANLNGFYLGGSHLSYANGINWAQWKGFYYSLKRTEMKIRRA |
| 7157 | Human MFAP4 isoform 2 (UniProtKB: P55083-2) | MGELSPLQRPLATEGTMKAQGVLLKLALLALPLLLLLSTPPCAPQVSGIRGDALERFCLQQPLDCDDI YAQGYQSDGVYLIYPSGPSVPVPVFCDMTTEGGKWTVFQKRFNGSVSFFRGWNDYKLGFGRADGEYWL GLQNMHLLTLKQKYELRVDLEDFENNTAYAKYADFSISPNAVSAEEDGYTLFVAGFEDGGAGDSLSYH SGQKFSTFDRDQDLFVQNCAALSSGAFWFRSCHFANLNGFYLGGSHLSYANGINWAQWKGFYYSLKRT EMKIRRA |
| 7158 | Human GRHPR isoform 1 (UniProtKB: Q9UBQ7-1, v1) | MRPVRLMKVFVTRRIPAEGRVALARAADCEVEQWDSDEPIPAKELERGVAGAHGLLCLLSDHVDKRIL DAAGANLKVISTMSVGIDHLALDEIKKRGIRVGYTPDVLTDTTAELAVSLLLTTCRRLPEAIEEVKNG GWTSWKPLWLCGYGLTQSTVGIIGLGRIGQAIARRLKPFGVQRPFLYTGRQPRPEEAAEFQAEFVSTPE LAAQSDFIVVACSLTPATEGLCNKDFFQKMKETAVFINISRGDVVNQDDLYQALASGKIAAAGLDVTS PEPLPTNHPLLTLKNCVILPHIGSATHRTRNTMSLLAANNLLAGLRGEPMPSELKL |
| 7159 | Human GRHPR isoform 2 (UniProtKB: Q9UBQ7-2) | MLGGVPTLCGTGNETWTLLALGQAIARRLKPFGVQRFLYTGRQPRPEEAAEFQAEFVSTPELAAQSDF IVVACSLTPATEGLCNKDFFQKMKETAVFINISRYPRATLPSKPGEEPSPLLPSGDFLPRGLLVRPQA ELAGFHKPNNQLRNSWEYTRPPYREEEPSEWAWPVCFSAVAPTRRGLAHSSVASGSVPREPLQAHYPP PQRAGLEDLKGPLEAASHTAEPGFVWLWFSDTLNLMLLGGQTLKLTWS |
| 7160 | Human ITFG1 (UniProtKB Q8TB96-1, v1) | MAAAGRLPSSWALFSPLLAGLALLGVGPVPARALHNVTAELFGAEAWGTLAAFGDLNSDKQTDLFVLR ERNDLIVFLADQNAPYFKPKVKVSFKNHSALITSVVPGDYDGDSQMDVLLTYLPKNYAKSELGAVIFW GQNQTLDPNNMTILNRTFQDEPLIMDFNGDLIPDIFGITNESNQPQILLGGNLSWHPALTTTSKMRIP HSHAFIDLTEDFTADLFLTTLNATTSTFQFEIWENLDGNFSVSTILEKPQNMMVVGQSAFADFDGDGH MDHLLPGCEDKNCQKSTIYLVRSGMKQWVPVLQDFSNKGTLWGFVPFVDEQQPTEIPIPITLHIGDYN MDGYPDALVILKNTSGSNQQAFLLENVPCNNASCEEARRMFKVYWELTDLNQIKDAMVATFFDIYEDG ILDIVVLSKGYTKNDFAIHTLKNNFEADAYFVKVIVLSGLCSNDCPRKITPFGVNQPGPYIMYTTVDA NGYLKNGSAGQLSQSAHLALQLPYNVLGLGRSANFLDHLYVGIPRPSGEKSIRKQEWTAIIPNSQLIV IPYPHNVPRSWSAKLYLTPSNIVLLTAIALIGVCVFILAIIGILHWQEKKADDREKRQEAHRFHFDAM |
| 7161 | Human ABCC4 isoform 1 (UniProtKB: O15439-1, v3) | MLPVYQEVKPNPLQDANLCSRVFFWWLNPLFKIGHKRRLEEDDMYSVLPEDRSQHLGEELQGFWDKEV LRAENDAQKPSLTRAIIKCYWKSYLVLGIFTLLIEESAKVIQPIFLGKIINYFENYDPMDSVALNTAYA YATVLTFCTLILAILHHLYFHVQCAGMRLRVAMCHMIYRKALRLSNMAMGKTTTGQIVNLLSNDVNK FDQVTVFLHFLWAGPLQAIAVTALLWMEIGISCLAGMAVLIILLPLQSCFGKLFSSLRSKTATFTDAR IRTMNEVITGIRIIKMYAWEKSFSNLITNLRKKEISKILRSSCLRGMNLASFFSASKIIVFVTPTTYV LLGSVITASRVFVAVTLYGAVRLTVTLFFPSAIERVSEAIVSIRRIQTFLLLDEISQRNRQLPSDGKK MVHVQDFTAFWDKASETPTLQGLFTVRPGELLAVVGPVGAGKSSLLSAVLGELAPSHGLVSVHGRIA YVSQQPWVFSGTLRSNILFGKKYEKERYEKVIKACALKKDLQLLEDGDLTVIGDRGTTLSGGQKARVN LARAVYQDADIYLLDDPLSAVDAEVSRHLFELCICQILHEKITILVTHQLQYLKAASQILILKDGKMV QKGTYTEFLKSGIDFGSLLKKDNEESEQPPVPGTPTLRNRTFSESSVWSQQSSRPSLKDGALESQDTE NVPVTLSEENRSEGKVGFQAYKNYFRAGAHWIVFIFLILLNTAAQVAYVLQDWWLSYWANKQSMLNVT VNGGGNVTEKLDLNWYLGIYSGLTVATVLFGIARSLLVFYVLVNSSQTLHNKMFESILKAPVLFFDRN PIGRILNRFSKDIGHLDDLLPLTFLDFIQTLLQVVGVVSVAVAVIPWIAIPLVPLGIIFIFLRRYFLE |

TABLE 14-continued

Target sequences.

| SEQ ID NO: | Description | Sequence |
|---|---|---|
| | | TSRDVKRLESTTRSPVFSHLSSSLQGLWTIRAYKAEERCQELFDAHQDLHSEAWFLFLTTSRWFAVRL<br>DAICAMFVIIVAFGSLILAKTLDAGQVGLALSYALTLMGMFQWCVRQSAEVENMMISVERVIEYTDLE<br>KEAPWEYQKRPPPAWPHEGVIIFDNVNFMYSPGGPLVLKHLTALIKSQEKVGIVGRTGAGKSSLISAL<br>FRLSEPEGKIWIDKILTTEIGLHDLRKKMSIIPQEPVLFTGTMRKNLDPFNEHTDEELWNALQEVQLK<br>ETIEDLPGKMDTELAESGSNFSVGQRQLVCLARAILRKNQILIIDEATANVDPRTDELIQKKIREKFA<br>HCTVLTIAHRLNTIIDSDKIMVLDSGRLKEYDEPYVLLQNKESLFYKMVQQLGKAEAAALTETAKQVY<br>FKRNYPHIGHTDHMVTNTSNGQPSTLTIFETAL |
| 7162 | Human ABCC4<br>isoform 2<br>(UniProtKB:<br>O15439-2) | MLPVYQEVKPNPLQDANLCSRVFFWWLNPLFKIGHKRRLEEDDMYSVLPEDRSQHLGEELQGFWDKEV<br>LRAENDAQKPSLTRAIIKCYWKSYLVLGIFTLIEESAKVIQPIFLGKIINYFENYDPMDSVALNTAYA<br>YATVLTFCTLILAILHHLYFYHVQCAGMRLRVAMCHMIYRKALRLSNMAMGKTTTGQIVNLLSNDVNK<br>FDQVTVFLHFLWAGPLQAIAVTALLWMEIGISCLAGMAVLIILLPLQSCFGKLFSSLRSKTATFTDAR<br>IRTMNEVITGIRIIKMYAWEKSFSNLITNLRKKEISKILRSSCLRGMNLASFFSASKIIVFVTFTTYV<br>LLGSVITASRVFVAVTLYGAVRLTVTLFFPSAIERVSEAIVSIRRIQTFLLLDEISQRNRQLPSDGKK<br>MVHVQDFTAFWDKASETPTLQGLSFTVRPGELLAVVGPVGAGKSSLLSAVLGELAPSHGLVSVHGRIA<br>YVSQQPWVFSGTLRSNILFGKKYEKERYEKVIKACALKKDLQLLEDGDLTVIGDRGTTLSGGQKARVN<br>LARAVYQDADIYLLDDPLSAVDAEVSRHLFELCICQILHEKITILVTHQLQYLKAASQILILKDGKMV<br>QKGTYTEFLKSGIDFGSLLKKDNEESEQPPVPGTPTLRNRTFSESSVW<br>SQQSSRPSLKDGALESQDVAYVLQDWWLSYWANKQSMLNVTVNGGGNVTEKLDLNWYLGIYSGLTVAT<br>VLFGIARSLLVFYVLVNSSQTLHNKMFESILKAPVLFFDRNPIGRILNRFSKDIGHLDDLLPLTFLDF<br>IQTLLQVVGVVSVAVAVIPWIAIPLVPLPLGIIFLRRYFLETSRDVKRLESTTRSPVFSHLSSSLQGL<br>WTIRAYKAEERCQELFDAHQDLHSEAWFLFLTTSRWFAVRLDAICAMFVIIVAFGSLILAKTLDAGQV<br>GLALSYALTLMGMFQWCVRQSAEVENMMISVERVIEYTDLEKEAPWEYQKRPPPAWPHEGVIIFDNVN<br>FMYSPGGPLVLKHLTALIKSQEKVGIVGRTGAGKSSLISALFRLSEPEGKIWIDKILTTEIGLHDLRK<br>KMSIIPQEPVLFTGTMRKNLDPFNEHTDEELWNALQEVQLKETIEDLPGKMDTELAESGSNFSVGQRQ<br>LVCLARAILRKNQILIIDEATANVDPRTDELIQKKIREKFAHCTVLTIAHRLNTIIDSDKIMVLDSGR<br>LKEYDEPYVLLQNKESLFYKMVQQLGKAEAAALTETAKQVYFKRNYPHIGHTDHMVTNTSNGQPSTLT<br>IFETAL |
| 7163 | Human ABCC4<br>isoform 3<br>(UniProtKB:<br>O15439-3) | MLPVYQEVKPNPLQDANLCSRVFFWWLNPLFKIGHKRRLEEDDMYSVLPEDRSQHLGEELQGFWDKEV<br>LRAENDAQKPSLTRAIIKCYWKSYLVLGIFTLIEESAKVIQPIFLGKIINYFENYDPMDSVALNTAYA<br>YATVLTFCTLILAILHHLYFYHVQCAGMRLRVAMCHMIYRKALRLSNMAMGKTTTGQIVNLLSNDVNK<br>FDQVTVFLHFLWAGPLQAIAVTALLWMEIGISCLAGMAVLIILLPLQSCFGKLFSSLRSKTATFTDAR<br>IRTMNEVITGIRIIKMYAWEKSFSNLITNLRKKEISKILRSSCLRGMNLASFFSASKIIVFVTFTTYV<br>LLGSVITASRVFVAVTLYGAVRLTVTLFFPSAIERVSEAIVSIRRIQTFLLLDEISQRNRQLPSDGKK<br>MVHVQDFTAFWDKASETPTLQGLSFTVRPGELLAVVGPVGAGKSSLLSAVLGELAPSHGLVSVHGRIA<br>YVSQQPWVFSGTLRSNILFGKKYEKERYEKVIKACALKKDLQLLEDGDLTVIGDRGTTLSGGQKARVN<br>LARAVYQDADIYLLDDPLSAVDAEVSRHLFELCICQILHEKITILVTHQLQYLKAASQILILKDGKMV<br>QKGTYTEFLKSGIDFGSLLKKDNEESEQPPVPGTPTLRNRTFSESSVWSQQSSRPSLKDGALESQDTE<br>NVPVTLSEENRSEGKVGFQAYKNYFRAGAHWIVFIFLILLNTAAQVAYVLQDWWLSYWANKQSMLNVT<br>VNGGGNVTEKLDLNWYLGIYSGLTVATVLFGIARSLLVFYVLVNSSQTLHNKMFESILKAPVLFFDRN<br>PIGRILNRFSKDIGHLDDLLPLTFLDFIQRWDLAVLSWLVSNS |
| 7164 | Human ABCC4<br>isoform 4<br>(UniProtKB:<br>O15439-4) | MLPVYQEVKPNPLQDANLCSRVFFWWLNPLFKIGHKRRLEEDDMYSVLPEDRSQHLGEELQGFWDKEV<br>LRAENDAQKPSLTRAIIKCYWKSYLVLGIFTLIEALRLSNMAMGKTTTGQIVNLLSNDVNKFDQVTVF<br>LHFLWAGPLQAIAVTALLWMEIGISCLAGMAVLIILLPLQSCFGKLFSSLRSKTATFTDARIRTMNEV<br>ITGIRIIKMYAWEKSFSNLITNLRKKEISKILRSSCLRGMNLASFFSASKIIVFVTFTTYVLLGSVIT<br>ASRVFVAVTLYGAVRLTVTLFFPSAIERVSEAIVSIRRIQTFLLLDEISQRNRQLPSDGKKMVHVQDF<br>TAFWDKASETPTLQGLSFTVRPGELLAVVGPVGAGKSSLLSAVLGELAPSHGLVSVHGRIAYVSQQPW<br>VFSGTLRSNILFGKKYEKERYEKVIKACALKKDLQLLEDGDLTVIGDRGTTLSGGQKARVNLARAVYQ<br>DADIYLLDDPLSAVDAEVSRHLFELCICQILHEKITILVTHQLQYLKAASQILILKDGKMVQKGTYTE<br>FLKSGIDFGSLLKKDNEESEQPPVPGTPTLRNRTFSESSVWSQQSSRPSLKDGALESQDTENVPVTLS<br>EENRSEGKVGFQAYKNYFRAGAHWIVFIFLILLNTAAQVAYVLQDWWLSYWANKQSMLNVTVNGGGNV<br>TEKLDLNWYLGIYSGLTVATVLFGIARSLLVFYVLVNSSQTLHNKMFESILKAPVLFFDRNPIGRILN<br>RFSKDIGHLDDLLPLTFLDFIQRWDLAVLSWLVSNS |
| 7165 | Human PAK3<br>isoform 1<br>(UniProtKB:<br>O75914-1, v2) | MSDGLDNEEKPPAPPLRMNSNNRDSSALNHSSKPLPMAPEEKNKKARLRSIFPGGGDKTNKKKEKERP<br>EISLPSDFEHTIHVGFDAVTGEFTPDLYGSQMCPGKLPEGIPEQWARLLQTSNITKLEQKKNPQAVLD<br>VLKFYDSKETVNNQKYMSFTSGDKSAHGYIAAHPSSTKTASEPPLAPPVSEEEDEEEEEEEDENEPPP<br>VIAPRPEHTKSIYTRSVVESIASPAVPNKEVTPPSAENANSSTLYRNTDRQRKKSKMTDEEILEKLRS<br>IVSVGDPKKKYTRFEKIGQGASGTVYTALDIATGQEVAIKQMNLQQQPKKELIINEILVMRENKNPNI<br>VNYLDSYLVGDELWVVMEYLAGGSLTDVVTETCMDEGQIAAVCRECLQALDFLHSNQVIHRDIKSDNI<br>LLGMDGSVKLTDFGFCAQITPEQSKRSTMVGTPYWMAPEVVTRKAYGPKVDIWSLGIMAIEMVEGEPP<br>YLNENPLRALYLIATNGTPELQNPERLSAVFRDFLNRCLEMDVDRRGSAKELLQHPFLKLAKPLSSLT<br>PLIIAAKEAIKNSSR |
| 7166 | Human PAK3<br>isoform 2<br>(UniProtKB:<br>O75914-2) | MSDGLDNEEKPPAPPLRMNSNNRDSSALNHSSKPLPMAPEEKNKKARLRSIFPGGGDKTNKKKEKERP<br>EISLPSDFEHTIHVGFDAVTGEFTGIPEQWARLLQTSNITKLEQKKNPQAVLDVLKFYDSKETVNNQK<br>YMSFTSGDKSAHGYIAAHPSSTKTASEPPLAPPVSEEEDEEEEEEEDENEPPPVIAPRPEHTKSIYTR<br>SVVESIASPAVPNKEVTPPSAENANSSTLYRNTDRQRKKSKMTDEEILEKLRSIVSVGDPKKKYTRFE<br>KIGQGASGTVYTALDIATGQEVAIKQMNLQQQPKKELIINEILVMRENKNPNIVNYLDSYLVGDELWV<br>VMEYLAGGSLTDVVTETCMDEGQIAAVCRECLQALDFLHSNQVIHRDIKSDNILLGMDGSVKLTDFGF<br>CAQITPEQSKRSTMVGTPYWMAPEVVTRKAYGPKVDIWSLGIMAIEMVEGEPPYLNENPLRALYLIAT<br>NGTPELQNPERLSAVFRDFLNRCLEMDVDRRGSAKELLQHPFLKLAKPLSSLTPLIIAAKEAIKNSSR |

TABLE 14-continued

Target sequences.

| SEQ ID NO: | Description | Sequence |
|---|---|---|
| 7167 | Human PAK3 isoform 3 (UniProtKB: O75914-3) | MSDGLDNEEKPPAPPLRMNSNNRDSSALNHSSKPLPMAPEEKNKKARLRSIFPGGGDKTNKKKEKERP EISLPSDFEHTIHVGFDAVTGEFTNSPFQTSRPVTVASSQSEGKMPDLYGSQMCPGKLPEGIPEQWAR LLQTSNITKLEQKKNPQAVLDVLKFYDSKETVNNQKYMSFTSGDKSAHGYIAAHPSSTKTASEPPLAP PVSEEEDEEEEEEEDENEPPPVIAPRPEHTKSIYTRSVVESIASPAVPNKEVTPPSAENANSSTLYRN TDRQRKKSKMTDEEILEKLRSIVSVGDPKKKYTRFEKIGQGASGTVYTALDIATGQEVAIKQMNLQQQ PKKELIINEILVMRENKNPNIVNYLDSYLVGDELWVVMEYLAGGSLTDVVTETCMDEGQIAAVCRECL QALDFLHSNQVIHRDIKSDNILLGMDGSVKLTDFGFCAQITPEQSKRSTMVGTPYWMAPEVVTRKAYG PKVDIWSLGIMAIEMVEGEPPYLNENPLRALYLIATNGTPELQNPERLSAVFRDFLNRCLEMDVDRRG SAKELLQHPFLKLAKPLSSLTPLIIAAKEAIKNSSR |
| 7168 | Human PAK3 isoform 4 (UniProtKB: O75914-4) | MSDGLDNEEKPPAPPLRMNSNNRDSSALNHSSKPLPMAPEEKNKKARLRSIFPGGGDKTNKKKEKERP EISLPSDFEHTIHVGFDAVTGEFTNSPFQTSRPVTVASSQSEGKMGIPEQWARLLQTSNITKLEQKKN PQAVLDVLKFYDSKETVNNQKYMSFTSGDKSAHGYIAAHPSSTKTASEPPLAPPVSEEEDEEEEEEED ENEPPPVIAPRPEHTKSIYTRSVVESIASPAVPNKEVTPPSAENANSSTLYRNTDRQRKKSKMTDEEI LEKLRSIVSVGDPKKKYTRFEKIGQGASGTVYTALDIATGQEVAIKQMNLQQQPKKELIINEILVMRE NKNPNIVNYLDSYLVGDELWVVMEYLAGGSLTDVVTETCMDEGQIAAVCRECLQALDFLHSNQVIHRD IKSDNILLGMDGSVKLTDFGFCAQITPEQSKRSTMVGTPYWMAPEVVTRKAYGPKVDIWSLGIMAIEM VEGEPPYLNENPLRALYLIATNGTPELQNPERLSAVFRDFLNRCLEMDVDRRGSAKELLQHPFLKLAK PLSSLTPLIIAAKEAIKNSSR |
| 7169 | Human TRNP1 (UniProtKB: Q6NT89-1, v2) | MPGCRISACGPGAQEGTAEQRSPPPPWDPMPSSQPPPPTPTLTPTPTGQSPPLPDAAGASAGAAEDQ ELQRWRQGASGIAGLAGPGGGSGAAAGAGGRALELAEARRRLLLEVEGRRRLVSELESRVLQLHRVFLA AELRLAHRAESLSRLSGGVAQAELYLAAHGSRLKKGPRRGRRGRPPALLASALGLGGCVPWGAGRLRR GHGPEPDSPFRRSPPRGPASPQR |
| 7170 | Human APLN (UniProtKB: Q9ULZ1-1, v1) | MNLRLCVQALLLLWLSLTAVCGGSLMPLPDGNGLEDGNVRHLVQPRGSRNGPGPWQGGRRKFRRQRPR LSHKGPMPF |
| 7171 | Apelin-36 (UniProtKB: Q9ULZ1-1, v1 positions 42-77) | LVQPRGSRNGPGPWQGGRRKFRRQRPRLSHKGPMPF |
| 7172 | Apelin-31 (UniProtKB: Q9ULZ1-1, v1 positions 47-77) | GSRNGPGPWQGGRRKFRRQRPRLSHKGPMPF |
| 7173 | Apelin-28 (UniProtKB: Q9ULZ1-1, v1 positions 50-77) | NGPGPWQGGRRKFRRQRPRLSHKGPMPF |
| 7174 | Apelin-13 (UniProtKB: Q9ULZ1-1, v1 positions 65-77) | QRPRLSHKGPMPF |
| 7175 | Human KIF20A isoform 1 (UniProtKB: O95235-1, v1) | MSQGILSPPAGLLSDDDVVVSPMFESTAADLGSVVRKNLLSDCSVVSTSLEDKQQVPSEDSMEKVKVY LRVRPLLPSELERQEDQGCVRIENVETLVLQAPKDSFALKSNERGIGQATHRFTFSQIFGPEVGQASF FNLTVKEMVKDVLKGQNWLIYTYGVTNSGKTHTIQGFTIKDGGILPRSLALIFNSLQGQLHPTPDLKPL LSNEVIWLDSKQIRQEEMKKLSLLNGGLQEEELSTSLKRSVYIESRIGTSTSFDSGIAGLSSISQCTS SSQLDETSHRWAQPDTAPLPVPANIRFSIWISFFEIYNELLYDLLEPPSQQRKRQTLRLCEDQNGNPY VKDLNWIHVQDAEEAWKLLKVGRKNQSFASTHLNQNSSRSHSIFSIRILHLQGEGDIVPKISELSLCD LAGSERCKDQKSGERLKEAGNINTLSLHTLGRCIAALRQNQQNRSKQNLVPFRDSKLTRVFQGFFTGRG RSCMIVNVNPCASTYDETLHVAKFSAIASQLVHAPPMQLGFPSLHSFIKEHSLQVSPSLEKGAKADTG LDDDIENEADISMYGKEELLQVVEAMKTLLLKERQEKLQLEMHLRDEICNEMVEQMQQREQWCSEHLD TQKELLEEMYEEKLNILKESLTSFYQEEIQERDEKIEELEALLQEARQQSVAHQQSGSELALRRSQRL AASASTQQLQEVKAKLQQCKAELNSTTEELHKYQKMLEPPPSAKPFTIDVDKKLEEGQKNIRLLRTEL QKLGESLQSAERACCHSTGAGKLRQALTTCDDILIKQDQTLAELQNNMVLVKLDLRKKAACIAEQYHT VLKLQGQVSAKKRLGTNQENQQPNQQPPGKKPFLRNLLPRTPTCQSSTDCSPYARILRSRRSPLLKSG PFGKKY |

TABLE 14-continued

Target sequences.

| SEQ ID NO: | Description | Sequence |
|---|---|---|
| 7176 | Human KIF20A isoform 2 (UniProtKB: O95235-2) | MSQGILSPPAGLLSDDDVVVSPMFESTAADLGSVVRKNLLSDCSVVSTSLEDKQQVPSEDSMEKEDQG CVRIENVETLVLQAPKDSFALKSNERGIGQATHRFTFSQIFGPEVGQASFFNLTVKEMVKDVLKGQNW LIYTYGVTNSGKTHTIQGTIKDGGILPRSLALIFNSLQGQLHPTPDLKPLLSNEVIWLDSKQIRQEEM KKLSLLNGGLQEEELSTSLKRSVYIESRIGTSTSFDSGIAGLSSISQCTSSSQLDETSHRWAQPDTAP LPVPANIRFSIWISFFEIYNELLYDLLEPPSQQRKRQTLRLCEDQNGRNPYVKDLNWIHVQDAEEAWKL LKVGRKNQSFASTHLNQNSSRSHSIFSIRILHLQGEGDIVPKISELSLCDLAGSERCKDQKSGERLKE AGNINTSLHTLGRCIAALRQNQQNRSKQNLVPFRDSKLTRVFQGFFTGRGRSCMIVNVNPCASTYDET LHVAKFSAIASQLVHAPPMQLGFPSLHSFIKEHSLQVSPSLEKGAKADTGLDDDIENEADISMYGKEE LLQVVEAMKTLLLLKERQEKLQLEMHLRDEICNEMVEQMQQREQWCSEHLDTQKELLEEMYEEKLNILK ESLTSFYQEEIQERDEKIEELEALLQEARQQSVAHQQSGSELALRRSQRLAASASTQQLQEVKAKLQQ CKAELNSTTEELHKYQKMLEPPPSAKPFTIDVDKKLEEGQKNIRLLRTELQKLGESLQSAERACCHST GAGKLRQALTTCDDILIKQDQTLAELQNNMVLVKLDLRKKAACIAEQYHTVLKLQGQVSAKKRLGTNQ ENQQPNQQPPGKKPFLRNLLPRTPTCQSSTDCSPYARILRSRRSPLLKSGPFGKKY |
| 7177 | Human LTB isoform 1 (UniProtKB: Q06643-1, v1) | MGALGLEGRGGRLQGRGSLLLAVAGATSLVTLLLAVPITVLAVLALVPQDQGGLVTETADPGAQAQQG LGFQKLPEEEPETDLSPGLPAAHLIGAPLKGQGLGWETTKEQAFLTSGTQFSDAEGLALPQDGLYYLY CLVGYRGRAPPGGGDPQGRSVTLRSSLYRAGGAYGPGTPELLLEGAETVTPVLDPARRQGYGPLWYTS VGFGGLVQLRRGERVYVNISHPDMVDFARGKTFFGAVMVG |
| 7178 | Human LTB isoform 2 (UniProtKB: Q06643-2) | MGALGLEGRGGRLQGRGSLLLAVAGATSLVTLLLAVPITVLAVLALVPQDQGGLGFRSCQRRSQKQIS APGSQLPTS |
| 7179 | Human MFAP4 transcript variant 1 mRNA NM_001198695.2 (GI: 1677501926 version 2) | GCAGACACCCAGCCACTCTGAGCAGAACTGACAGCATGAAGGTACGGGGCCCAGGGTCGGGGGACTCA TAGCATGGGGGAACTGAGCCCACTCCAGAGGCCCCTGGCCACAGAGGGCACTATGAAGGCACAAGGAG TTCTCTTGAAACTCGCACTCCTGGCCCTGCCGCTGCTGCTGCTTCTCTCCACGCCCCCGTGTGCCCCC CAGGTCTCCGGGATCCGAGGAGATGCTCTGGAGAGGTTTTGCCTTCAGCAACCCCTGGACTGTGACGA CATCTATGCCCAGGGCTACCAGTCAGACGGCGTGTACCTCATCTACCCCTCGGGCCCCAGTGTGCCTG TGCCCGTCTTCTGTGACATGACCACCGAGGGCGGGAAGTGGACGGTTTTCCAGAAGAGATTCAATGGC TCAGTAAGTTTCTTCCGCGGCTGGAATGACTACAAGCTGGGCTTCGGCCGTGCTGATGGAGAGTACTG GCTGGGGCTGCAGAACATGCACCTCCTGACACTGAAGCAGAAGTATGAGCTGCGAGTGGACTTGGAGG ACTTTGAGAACAACACGGCCTATGCCAAGTACGCTGACTTCTCCATCTCCCCGAACGCGGTCAGCGCA GAGGAGGATGGCTACACCCTCTTTGTGGCAGGCTTTGAGGATGGCGGGGCAGGTGACTCCTCGTCCTA CCACAGTGGCCAGAAGTTCTCTACCTTCGACCGGGACCAGGACCTCTTTGTGCAGAACTGCGCAGCTC TCTCCTCAGGAGCCTTCTGGTTCCGCAGCTGCCACTTTGCCAACCTCAATGGCTTCTACCTAGGTGGC TCCCACCTCTCTTATGCCAATGGCATCAACTGGGCCCAGTGGAAGGGCTTCTACTACTCCCTCAAACG CACTGAGATGAAAATCCGCCGGGCCTGAAGGGCTGGCCCCCTGAAGGGCTGGCCCCCTCAGGCACCTG GCTCCTCCTTGCTCCCCTGCTGATGGTGTCCTACCCCGAACTCCAAAAATTACACCTGGAGTCAGGTG CATGGTCTCCATGAGTGCTCCCTCTGCTGCCCCTGATGCATGCTTCTGCTGATTCCCGAGCACCAACT CCTTACAAGGGGGCCTTGTGGCTCTCAGCCATGCCACATCCCTGTCACACACCCAGGGCATCCATTCC TAAGCCAGACCCGGCTCCCCTACACCTGAAGTTACACTGCCAGCAGTTCCCCAGGCCTCTTCCGAGAG GCACATGGTTCTAGCCTGGACCTGGCTGGGCTCCATGAGAATGAGTTGCCTCCAACCTGTCCCAACAG CTGACAGCCAGGAGCCACTCTCCCAGCTGCAGGCCTTTGTGGTCCATCTTGTCCTGCTTCCTCACTGT GGACCCCTGTCTGGGCCACCCTAGTGTGCTAAGCTGAGCAGTGCAGTGTGAACAGGGCCCATGGTGTA TTCTAGGCCACAGCCCAGCACTCCTCTGGGCTGCTCTCAAACCATGTCCCATCTTCAGCATCCCTCCC ACCAACTTACTCCCCTGTGGTGAGTACCGTGGAACCCCAGCCCACCTCACTATCATACTCAGCTTCCC CTGATGGCCCATCCCAGCCCCTGAAGCTCTATGCCAAGAACACAGCTACCGCACACCACCCTGAAACA GCCACAGCCAAGGTAGGCATGCATATGAGGTCTTCCCCATACCCTCTGGGTGTTGAGAGGTTTAGCCA CATGAGGGAGCAGAGGACAATCTCTGCAGGGCTGGGAGTGGGTAGGGACTGAAGGTCTCAATAAACCT TCAGAACCTGAATGAACTGGCTTCATACACACAAACATATTTGTTTATCCCCAAATGTAGGCACCTG GCTCCTCCTTGCTCCCCTGCTGATGGTGTCCTACCCCGAACTCCAAAAATTACACCTGGAGTCAGGTG CAGAAGGGAACCTTGTATTTCACAGGCCTCATTTTGATGGCAAAAAGACAGTGTAATAATAACATAAT AATAATAAAAATATAATACTGAAAA |
| 7180 | Human MFAP4 transcript variant 2 mRNA NM_002404.3 (GI: 1677501522 version 3) | GCAGACACCCAGCCACTCTGAGCAGAACTGACAGCATGAAGGCACTCCTGGCCCTGCCGCTGCTGCTG CTTCTCTCCACGCCCCCGTGTGCCCCCCAGGTCTCCGGGATCCGAGGAGATGCTCTGGAGAGGTTTTG CCTTCAGCAACCCCTGGACTGTGACGACATCTATGCCCAGGGCTACCAGTCAGACGGCGTGTACCTCA TCTACCCCTCGGGCCCCAGTGTGCCTGTGCCCGTCTTCTGTGACATGACCACCGAGGGCGGGAAGTGG ACGGTTTTCCAGAAGAGATTCAATGGCTCAGTAAGTTTCTTCCGCGGCTGGAATGACTACAAGCTGGG CTTCGGCCGTGCTGATGGAGAGTACTGGCTGGGGCTGCAGAACATGCACCTCCTGACACTGAAGCAGA AGTATGAGCTGCGAGTGGACTTGGAGGACTTTGAGAACAACACGGCCTATGCCAAGTACGCTGACTTC TCCATCTCCCCGAACGCGGTCAGCGCAGAGGAGGATGGCTACACCCTCTTTGTGGCAGGCTTTGAGGA TGGCGGGGCAGGTGACTCCCTGTCCTACCACAGTGGCCAGAAGTTCTCTACCTTCGACCGGGACCAGG ACCTCTTTGTGCAGAACTGCGCAGCTCTCTCCTCAGGAGCCTTCTGGTTCCGCAGCTGCCACTTTGCC AACCTCAATGGCTTCTACCTAGGTGGCTCCCACCTCTCTTATGCCAATGGCATCAACTGGGCCCAGTG GAAGGGCTTCTACTACTCCCTCAAACGCACTGAGATGAAAATCCGCCGGGCCTGAAGGGCTGGCCCCC TCAGGCACCTTCCTCCCCTGGACACCCATGGTCTCCATGAGTGCTCCCTCTGCTGCCCCTGATGCAT GCTTCTGCTGATTCCCGAGCACCAACTCCTTACAAGGGGGCCTTGTGGCTCTCAGCCATGCCACATCC CTGTCACACACCCAGGGCATCCATTCCTAAGCCAGACCCGGCTCCCCTACACCTGAAGTTACACTGCC AGCAGTTCCCCAGGCCTCTTCCGAGAGGCACATGGTTCTAGCCTGGACCTGGCTGGGCTCCATGAGAA TGAGTTGCCTCCAACCTGTCCCAACAGCTGACAGCCAGGAGCCACTCTCCCAGCTGCAGGCCTTTGTG GTCCATCTTGTCCTGCTTCCTCACTGTGGACCCCTGTCTGGGCCACCCTAGTGTGCTAAGCTGAGCAG TGCAGTGTGAACAGGGCCCATGGTGTATTCTAGGCCACAGCCCAGCACTCCTCTGGGCTGCTCTCAAA CCATGTCCCATCTTCAGCATCCCTCCCACCAACTTACTCCCCTGTGGTGAGTACCGTGGAACCCCAGC CCACCTCACTATCATACTCAGCTTCCCCTGATGGCCCATCCCAGCCCCTGAAGCTCTATGCCAAGAAC ACAGCTACCGCACACCACCCTGAAACAGCCACAGCCAAGGTAGGCATGCATATGAGGTCTTCCCCATA |

TABLE 14-continued

Target sequences.

| SEQ ID NO: | Description | Sequence |
|---|---|---|
| | | CCCTCTGGGTGTTGAGAGGTTTAGCCACATGAGGGAGCAGAGGACAATCTCTGCAGGGCTGGGAGTGG<br>GTAGGGACTGAAGGTCTCAATAAACCTTCAGAACCTGAATGAACTGGCTTCATACACACAAACATATT<br>TGTTTATCCCCCAAATGTAGGCACCTGGCTCCTCCTTGCTCCCCTGCTGATGGTGTCCTACCCCGAAC<br>TCCAAAAATTACACCTGGAGTCAGGTGCAGAAGGGAACCTTGTATTTCACAGGCCTCATTTTGATGGC<br>AAAAAGACAGTGTAATAATAACATAATAATAATAAAAATATAATACTGAAAA |
| 7181 | Human GRHPR<br>transcript variant<br>1 mRNA<br>NM_012203.2<br>(GI: 1519473711<br>version 2) | ACATTCCCGGGCCAGCTTCTGTACTGCCAGGTCCGGGTCGGCGGCTGCACTGCGGATGAGACCGGTGC<br>GACTCATGAAGGTGTTCGTCACCCGCAGGATACCCGCCGAGGGTAGGGTCGCGCTCGCCCGGGCGGCA<br>GACTGTGAGGTGGAGCAGTGGGACTCGGATGAGCCCATCCCTGCCAAGGAGCTAGAGCGAGGTGTGGC<br>GGGGGCCCACGGCCTGCTCTGCCTCCTCTCCGACCACGTGGACAAGAGGATCCTGGATGCTGCAGGGG<br>CCAATCTCAAAGTCATCAGCACCATGTCTGTGGGCATCGACCACTTGGCTTTGGATGAAATCAAGAAG<br>CGTGGGATCCGAGTTGGCTACACCCCAGATGTCCTGACAGATACCACCGCCGAACTCGCAGTCTCCCT<br>GCTACTTACCACCTGCCGCCGGTTGCCGGGAGCCATCGAGGAAGTGAAGAATGGTGGCTGGACCTCGT<br>GGAAGCCCCTCTGGCTGTGTGGCTATGGACTCACGCAGAGCACTGTCGGCATCATCGGGCTGGGGCGC<br>ATAGGCCAGGCCATTGCTCGGCGTCTGAAACCATTCGGTGTCCAGAGATTTCTGTACACAGGGCGCCA<br>GCCCAGGCCTGAGGAAGCAGCAGAATTCCAGGCAGAGTTTGTGTCTACCCCTGAGCTGGCTGCCCAAT<br>CTGATTTCATCGTCGTGGCCTGCTCCTTAACACCTGCAACCGAGGGACTCTGCACAAGGACTTCTTC<br>CAGAAGATGAAGGAAACAGCTGTGTTCATCAACATCAGCAGGGGCGACGTCGTAAACCAGGACGACCT<br>GTACCAGGCCTTGGCCAGTGGTAAGATTGCAGCTGCTGGACTGGATGTGACGAGCCCAGAACCACTGC<br>CTACAAACCACCCTCTCCTGACCCTGAAGAACTGTGTGATTCTGCCCCACATTGGCAGTGCCACCCAC<br>AGAACCCGCAACACCATGTCCTTGTTGGCAGCTAACAACTTGGTCTGGCTGGCCTGAGAGGGGAGCCGT<br>GCCTAGTGAACTCAAGCTGTAGCCAAACAGTAGAGATGGAGGGCCGGAAGCAAACCGTGCCCTGGTA<br>TTGTCAGACACACCCAGGCTTGATTTGGATCCACAGGCAGAGCCAAGGGAAGGTGTGATTCTCTGAGG<br>AAAGAGTGATTCTGATATATGTACTTGTCACATTGGTGTTGGACACATTTGCGCCAAAAGTATGGTAA<br>TTCTATTATTAAATAATTCTCTGAGA |
| 7182 | Human ITFG1<br>transcript variant<br>1 mRNA<br>NM_030790.5<br>(GI: 1653961895<br>version 5) | GGGGGCTGAGGGGCTGCCATGGCGGCGGCGGGCCGGCTCCCGAGCTCCTGGGCCCTCTTCTCGCCGCT<br>CCTCGCAGGGCTTGCACTACTGGGAGTCGGGCCGGTCCCAGCGCGGGCGCTGCACAACGTCACGGCCG<br>AGCTCTTTGGGGCCGAGGCCTGGGGCACCCTTGCGGCTTTCGGGGACCTCAACTCCGACAAGCAGACG<br>GATCTCTTCGTGCTGCGGGAAAGAAATGACTTAATCGTCTTTTTGGCAGACAGAATGCACCCTATTT<br>TAAACCCAAAGTAAAGGTATCTTTCAAGAATCACAGTGCATTGATAACAAGTGTAGTCCCTGGGGATT<br>ATGATGGAGATTCTCAAATGGATGTCCTTCTGACATATCTTCCCAAAAATTATGCCAAGAGTGAATTA<br>GGAGCTGTTATCTTCTGGGGACAAAATCAAACATTAGATCCTAACAATATGACCATACTCAATAGGAC<br>TTTTCAAGATGAGCCACTAATTATGGATTTCAATGGTGATCTAATTCCTGATATTTTTGGTATCACAA<br>ATGAATCCAACCAGCCACAGATACTATTAGGAGGGAATTTATCATGGCATCCAGCATTGACCACTACA<br>AGTAAAATGCGAATTCCACATTCTCATGCATTTATTGATCTGACTGAAGATTTTACAGCAGATTTATT<br>CCTGACGACATTGAATGCCACCACTAGTACCTTCCAGTTTGAAATATGGGAAAATTTGGATGGAAACT<br>TCTCTGTCAGTACTATATTGGAAAAACCTCAAAATATGATGGTGGTTGGACAGTCAGCATTTGCAGAC<br>TTTGATGGAGATGGACACATGGATCATTTACTGCCAGGCTGTGAAGATAAAAATTGCCAAAAGAGTAC<br>CATCTACTTAGTGAGATCTGGGATGAAGCAGTGGGTTCCAGTCCTACAAGATTTCAGCAATAAGGGCA<br>CACTCTGGGGCTTTGTGCCATTTGTGGATGAACAGCAACCAACTGAAATACCAATTCCAATTACCCTT<br>CATATTGGAGACTACAATATGGATGGCTACCAGACGCTCTGGTCATACTAAAGACACATCTGGAAG<br>CAACCAGCAGGCCTTTTTACTGGAGAACGTCCCTTGTAATAATGCAAGCTGTGAAGAGGCGCGTCGAA<br>TGTTTAAAGTCTACTGGGAGCTGACAGACCTAAATCAAATTAAGGATGCCATGGTTGCCACCTTCTTT<br>GACATTTACGAAGATGGAATCTTGGACATTGTAGTGCTAAGTAAAGGATATACAAAGAATGATTTTGC<br>CATTCATACACTAAAAAATAACTTTGAAGCAGATGCTTTATTTTGTTAAAGTTATTGTTCTTAGTGGTC<br>TGTGTTCTAATGACTGTCCTCGTAAGATAACACCCTTTGGAGTGAATCAACCTGGACCTTATATCATG<br>TATACAACTGTAGATGCAAATGGGTATCTGAAAAATGGATCAGCTGGCCAACTCAGCCAATCCGCACA<br>TTTAGCTCTCCAACTACCATACAACGTGCTTGGTTTAGGTCGGAGCGCAAATTTTCTTGACCATCTCT<br>ACGTTGGTATTCCCCGTCCATCTGGAGAAAAATCTATACGAAAACAAGAGTGGACTGCAATCATTCCA<br>AATTCCCAGCTAATTGTCATTCCATACCCTCACAATGTCCCTCGAAGTTGGAGTGCCAAACTGTATCT<br>TACACCAAGTAATATTGTTCTGCTTACTGCTATAGCTCTCATCGGTGTCTGTGTTTTCATCTTGGCAA<br>TAATTGGCATTTTACATTGGCAGGAAAAGAAAGCAGATGATAGAGAAAAACGACAAGAAGCCCACCGG<br>TTTCATTTTGATGCTATGTGACTTGCCTTTAATATTACATAATGGAATGGCTGTTCACTTGATTAGTT<br>GAAACACAAATTCTGGCTTGAAAAAATAGGGGAGATTAAATATTATTTATAAATGATGTATCCCATGG<br>TAATTATTGGAAAGTATTCAAATAAATATGGTTTGAATATGTCACAAGGTCTTTTTTTTAAAGCACT<br>TTGTATATAAAAATTTGGGTTCTCTATTCTGTAGTGCTGTACATTTTTGTTCCTTTGTGGAATGTGTT<br>GCATGTACTCCAGTGTTTGTGTATTTATAATCTTATTTGCATCATGATGATGGAAAAGTTGTGTAAA<br>TAAAAATAATTAAATGAGCAGGAATTTTTGTGTCCACTTGACTTGGTCTTGCTTCTTTATTCTAATGAT<br>GCAAATTATACTTTTGTGAATATATCACGGAGTCATTAGGCATTCAGCTTCATCACAGCAGGTCAGGG<br>GTCTCACTGATGGCATACAATATAGTGATCGGGTACTCTGACTTGGTAGCACAGTAAGACAGACTTGC<br>CTTAAACTCCTAATTCAACACTTACAAAGTCATTGTTTGAACTTGGCTCTTGTTTAACCTCTGTAAA<br>CCTCAGTTTTCTTGTTTATTCAGTGGGGCTAATACTTGAGTTACTGTAAACATTAAATGGGATGATGT<br>ATGTGAAGTGCTTAGCTTGGTGCCTAGCACAGAGTAAGTGGTCAATATGTGGTAGTTGTCATTATTAA<br>TATTTTAGATGATCTTATTAGACTTATACATCTAATTATAGAAATACATAGACTTGATAGAATTTTAT<br>TTTCAGGCATGAAGAAATATTCTTTGGAAAAGCTAAATTTTTGGTGATTGACATAAAGATTTACTTGC<br>TCATATTAACTAAAAATTATAGTACTCTCCAAGAATTAATGTGCCCTAAAAATTTTCCTCCAAAAACT<br>TATCCTTATCATGTGATAATGAAGAACATTTGATTTCTTGAAAGGAAACTGCTGTAGGCAGCATCTGG<br>GAATGCAAATCTTCAATCACATTTCTATTCTCAAACACTTTGGAGAAGTCTATAATTTACATTCAGACT<br>TCAATGCAAATTTTGTATTGTGAACTTCACATTTCCAAAAAGTTACTTTAAAAAGACTTTAAGACTGA<br>AAAAAAAAGTTTATCAGTCGTAATAATTTTCTAGTATGCAAATGGACATGTGAGTGCCTATAAAACAC<br>AAAAATTTCTCTGAAAACAATTTTGTTCTTATTTTTTCTTTATAGTTCACTGAGATTGGCATGTGTT<br>TTTACTTTGTATCTAAGCATGTTAACATGTCTTCTTAATAAATATTCCTTATTGAAA |
| 7183 | Human ABCC4<br>transcript variant | GCTTCACAGGCTCCAGCCGAGCGGACAGGCGTGGCGGCCGGAGCCCCAGCATCCCTGCTTGAGGTCCA<br>GGAGCGGAGCCCGCGGCCACCGCCGCCTGATCAGCGCGACCCCGGCCCGCGCCCGCCCCGGCAA |

TABLE 14-continued

Target sequences.

| SEQ ID NO: | Description | Sequence |
| --- | --- | --- |
| | 1 mRNA<br>NM_005845.5<br>(GI: 1813751621<br>version 5) | GATGCTGCCCGTGTACCAGGAGGTGAAGCCCAACCCGCTGCAGGACGCGAACCTCTGCTCACGCGTGT<br>TCTTCTGGTGGCTCAATCCCTTGTTTAAAATTGGCCATAAACGGAGATTAGAGGAAGATGATATGTAT<br>TCAGTGCTGCCAGAAGACCGCTCACAGCACCTTGGAGAGGAGTTGCAAGGGTTCTGGGATAAAGAAGT<br>TTTAAGAGCTGAGAATGACGCACAGAAGCCTTCTTTAACAAGAGCAATCATAAAGTGTTACTGGAAAT<br>CTTATTTAGTTTTGGGAATTTTTACGTTAATTGAGGAAAGTGCCAAAGTAATCCAGCCCATATTTTTG<br>GGAAAAATTATTAATTATTTTGAAAATTATGATCCCATGGATTCTGTGGCTTTGAACACAGCGTACGC<br>CTATGCCACGGTGCTGACTTTTTGCACGCTCATTTTGGCTATACTGCATCACTTATATTTTTATCACG<br>TTCAGTGTGCTGGGATGAGGTTACGAGTAGCCATGTGCCATATGATTTATCGGAAGGCACTTCGTCTT<br>AGTAACATGGCCATGGGGAAGACAACCACAGGCCAGATAGTCAATCTGCTGTCCAATGATGTGAACAA<br>GTTTGATCAGGTGACAGTGTTCTTACACTTCCTGTGGGCAGGACCACTGCAGGCGATTGCAGTGACTG<br>CCCTACTCTGGATGGAGATAGGAATATCGTGCCTTGCTGGGATGGCAGTTCTAATCATTCTCCTGCCC<br>TTGCAAAGCTGTTTTGGGAAGTTGTTCTCATCACTGAGGAGTAAAACTGCAACTTTCACGGATGCCAG<br>GATCAGGACCCATGAATGAAGTTATAACTGGTATAAGGATAATAAAAATGTACGCCTGGGAAAAGTCAT<br>TTTCAAATCTTATTACCAATTTGAGAAAGAAGGAGATTTCCAAGATTCTGAGAAGTTCCTGCCTCAGA<br>GGGATGAATTTGGCTTCATTTTTCAGTCAAGCAAAATCATCGTGTTTGTGACCTTCACCACCTACGT<br>GCTCCTCGGCAGTGTGATCACAGCCAGCCGCGTGTTCGTGGCAGTGACGCTGTATGGGGCTGTGCGGC<br>TGACGGTTACCCTCTTCTTCCCCTCAGCCATTGAGAGGGTGTCAGAGGCAATCGTCAGCATCCGAAGA<br>ATCCAGACCTTTTTGCTACTTGATGAGATATCACAGCGCAACCGTCAGCTGCCGTCAGATGGTAAAAA<br>GATGGTGCATGTGCAGGATTTTACTGCTTTTTGGGATAAGGCATCAGAGACCCCAACTCTACAAGGCC<br>TTTCCTTTACTGTCAGACCTGGCGAATTGTTAGCTGTGGTCGGCCCCGTGGGAGCAGGGAAGTCATCA<br>CTGTTAAGTGCCGTGCTCGGGGAATTGGCCCCAAGTCACGGGCTGGTCAGCGTGCATGGAAGAATTGC<br>CTATGTGTCTCAGCAGCCCTGGGTGTTCTCGGGAACTCTGAGGAGTAATATTTTATTTGGGAAGAAAT<br>ACGAAAAGGAACGATATGAAAAAGTCATAAAGGCTTGTGCTCTGAAAAAGGATTTACAGCTGTTGGAG<br>GATGGTGATCTGACTGTGATAGGAGATCGGGGAACCACGCTGAGTGGAGGGCAGAAAGCACGGGTAAA<br>CCTTGCAAGAGCAGTGTATCAAGATGCTGACATCTATCTCCTGGACGATCCTCTCAGTGCAGTAGATG<br>CGGAAGTTAGCAGACACTTGTTCGAACTGTGTATTTGTCAAATTTTGCATGAGAAGATCACAATTTTA<br>GTGACTCATCAGTTGCAGTACCTCAAAGCTGCAAGTCAGATTCTGATATTGAAAGATGGTAAAATGGT<br>GCAGAAGGGGACTTACACTGAGTTCCTAAAATCTGGTATAGATTTTGGCTCCCTTTTAAAGAAGGATA<br>ATGAGGAAAGTGAACAACCTCCAGTTCCAGGAACTCCCACACTAAGGAATCGTACCTTCTCAGAGTCT<br>TCGGTTTGGTCTCAACAATCTTCTAGACCCTCCTTGAAAGATGGTGCTCTGGAGAGCCAAGATACAGA<br>GAATGTCCCAGTTACACTATCAGAGGAGAACCGTTCTGAAGGAAAAGTTGGTTTTCAGGCCTATAAGA<br>ATTACTTCAGAGCTGGTGCTCACTGGATTGTCTTCATTTTCCTTATTCTCCTAAACACTGCAGCTCAG<br>GTTGCCTATGTGCTTCAAGATTGGTGGCTTTCATACTGGGCAAACAAACAAAGTATGCTAAATGTCAC<br>TGTAAATGGAGGAGGAAATGTAACCGAGAAGCTAGATCTTAACTGGTACTTAGGAATTTATTCAGGTT<br>TAACTGTAGCTACCGTTCTTTTTGGCATAGCAAGATCTCTATTGGTATTCTACGTCCTTGTTAACTCT<br>TCACAAACTTTGCACAACAAAATGTTTGAGTCAATTCTGAAAGCTCCGGTATTATTCTTTGATAGAAA<br>TCCAATAGGAAGAATTTTAAATCGTTTCTCCAAAGACATTGGACACTTGGATGATTTGCTGCCGCTGA<br>CGTTTTTAGATTTCATCCAGCATTGCTACAAGTGGTTGGTGTGGTCTCTGTGGCTGTGGCCGTGATT<br>CCTTGGATCGCAATACCCTTGGTTCCCCTTGGAATCATTTTCATTTTTCTTCGGCGATATTTTTGGA<br>AACGTCAAGAGATGTGAAGCGCCTGGAATCTACAACTCGGAGTCCAGTGTTTTCCCACTTATCATCTT<br>CTCTCCAGGGGCTCTGGACCATCCGGGCATACAAAGCAGAAGAGAGGTGTCAGGAACTGTTTGATGCA<br>CACCAGGATTTACATTCAGAGGCTTGGTTCTTGTTTTTGACAACGTCCCGCTGGTTTGCCGTCCGTCT<br>GGATGCCATCTGTGCCATGTTTGTCATCATCGTTGCCTTTGGGTCCCTGATTCTGGCAAAAACTCTGG<br>ATGCCGGGCAGGTTGGTTTGGCACTGTCCTATGCCCTCACGCTCATGGGGATGTTTCAGTGGTGTGTT<br>CGACAAAGTGCTGAAGTTGAGAATATGATGATCTCAGTAGAAAGGGTCATTGAATACACAGACCTTGA<br>AAAAGAAGCACCTTGGGAATATCAGAAACGCCCACCACCAGCCTGGCCCCATGAAGGAGTGATAATCT<br>TTGACAATGTGAACTTCATGTACAGTCCAGGTGGGCCTCTGGTACTGAAGCATCTGACAGCACTCATT<br>AAATCACAAGAAAGGTTGGCATTGTGGGAAGAACCGGAGCTGGAAAAAGTTCCCTCATCTCAGCCCTT<br>TTTTAGATTGTCAGAACCCGAAGGTAAAATTTGGATTGATAAGATCTTGACAACTGAAATTGGACTTC<br>ACGATTTAAGGAAGAAGATGTCAATCATACCTCAGGAACCTGTTTTGTTCACTGGAACAATGAGGAAA<br>AACCTGGATCCCTTTAATGAGCACACACGGATGAGGAACTGTGGAATGCCTTACAAGAGGTACAACTTAA<br>AGAAACCATTGAAGATCTTCCTGGTAAAATGGATACTGAATTAGCAGAATCAGGATCCAATTTTAGTG<br>TTGGACAAAGACAACTGGTGTGCCTTGCCAGGGCAATTCTCAGGAAAAATCAGATATTGATTATTGAT<br>GAAGCGACGGCAAATGTGGATCCAAGAACTGATGAGTTAATACAAAAAAAAAATCCGGGAGAAATTTGC<br>CCACTGCACCGTGCTAACCATTGCACACAGATTGAACACCATTATTGACAGCGACAAGATAATGGTTT<br>TAGATTCAGGAAGACTGAAGAATATGATGAGCCGTATGTTTGCTGCAAAATAAAGAGAGCCTATTT<br>TACAAGATGGTGCAACAACTGGGCAAGGCAGAAGCCGCTGCCCTCACTGAAACAGCAAAACAGGTATA<br>CTTCAAAAGAAATTATCCACATATTGGTCACACTGACCACATGTTACAAACACTTCCAATGGACAGC<br>CCTCGACCTTAACTATTTTCGAGACAGCACTGTGAATCCAACCAAAAATGTCAAGTCCGTTCCGAAGGC<br>ATTTTCCACTAGTTTTTGGACTATGTAAACCACATTGTACTTTTTTTTACTTTGGCAACAAATATTTA<br>TACATACAAGATGCTAGTTCATTTGAATATTTCTCCCAACTTATCCAAGGATCTCCAGCTCTAACAAA<br>ATGGTTTATTTTTATTTAAATGTCAATAGTTGTTTTTAAAATCCAAATCAGAGGTGCAGGCCACCAG<br>TTAAATGCCGTCTATCAGGTTTTGTGCCTTAAGAGACTACAGAGTCAAAGCTCATTTTAAAGGAGTA<br>GGACAAAGTTGTCACAGGTTTTTGTTGTTGTTTTATTGCCCCCAAAATTACATGTTAATTTCCATTT<br>ATATCAGGGATTCTATTTACTTGAAGACTGTGAAGTTGCCATTTTGTCTCATTGTTTTCTTTGACATA<br>ACTAGGATCCATTATTTCCCCTGAAGGCTTCTTGTTAGAAAATAGTACAGTTACAACCAATAGG<br>AACAACAAAAAGAAAAGTTTGTGACATTGTAGTAGGGAGTGTGTACCCCTTACTCCTCCCATCAAAAA<br>AAAAATGGATACATGGTTAAAGGATAGAAGGGCAATATTTTATCATATGTTCTAAAAGAAGGAAGA<br>GAAAATACTACTTTCTCAAAATGGAAGCCCTTAAAGGTGCTTTGATACTGAAGGACACAAATGTGACC<br>GTCCATCCTCCTTTAGAGTTGCATGACTTGGACACGGTAACTGTTCAGTTTTAGACTCAGCATTGTG<br>ACACTTCCCAAGAAGGCCAAACCTCTAACCGACATTCCTGAAATACGTGGCATTATTCTTTTTTGGAT<br>TTCTCATTTATGGAAGGCTAACCCTCTGTTGACTGTAAGCCTTTTGGTTTGGGCTGTATTGAAATCCT<br>TTCTAAATTGCATGAATAGGCTCTGCTAACGTGATGAGACAAACTGAAAATTATTGCAAGCATTGACT<br>ATAATTATGCAGTACGTTCTCAGGATGCATCCAGGGGTTCATTTTCATGAGCCTGTCCAGGTTAGTTT<br>ACTCCTGACCACTAATAGCATTGTCATTTGGGCTTTCTGTTGAATGAATCAACAAACCACAATACTTC<br>CTGGGACCTTTTGTACTTTATTTGAACTATGAGTCTTTAATTTTTCCTGATGATGGTGGCTGTAATAT |

TABLE 14-continued

Target sequences.

| SEQ ID NO: | Description | Sequence |
|---|---|---|
| | | GTTGAGTTCAGTTTACTAAAGGTTTTACTATTATGGTTTGAAGTGGAGTCTCATGACCTCTCAGAATA<br>AGGTGTCACCTCCCTGAAATTGCATATATGTATATAGACATGCACACGTGTGCATTTGTTTGTATACA<br>TATATTTGTCCTTCGTATAGCAAGTTTTTTGCTCATCAGCAGAGAGCAACAGATGTTTTATTGAGTGA<br>AGCCTTAAAAAGCACACACCACACACAGCTAACTGCCAAAATACATTGACCGTAGTAGCTGTTCAACT<br>CCTAGTACTTAGAAATACACGTATGGTTAATGTTCAGTCCAACAAACCACACACAGTAAATGTTTATT<br>AATAGTCATGGTTCGTATTTTAGGTGACTGAAATTGCATCAGTGATCATAATGAGGTTTGTTAAAACG<br>ATAGCTATATTCAAAATGTCTATATGTTTATTTGGACTTTTGAGGTTAAAGACAGTCATATAAACGTC<br>CTGTTTCTGTTTTAATGTTATCATAGAATTTTTTAATGAAACTAAATTCAATTGAAATAAATGATAGT<br>TTTCATCTCCA |
| 7184 | Human ABCC4<br>transcript variant<br>2 mRNA<br>NM_001105515.3<br>(GI: 1677498821<br>version 3) | GCTTCACAGGCTCCAGCCGAGCGGACAGGCGTGGCGGCCGGAGCCCCAGCATCCCTGCTTGAGGTCCA<br>GGAGCGGAGCCCGCGGCCACCGCCGCCTGATCAGCGCGACCCCGGCCCGCGCCCGCCCCGCCCGGCAA<br>GATGCTGCCCGTGTACCAGGAGGTGAAGCCCAACCCGCTGCAGGACGCGAACCTCTGCTCACGCGTGT<br>TCTTCTGGTGGCTCAATCCCTTGTTTAAAATTGGCCATAAACGGAGATTAGAGGAAGATGATATGTAT<br>TCAGTGCTGCCAGAAGACCGCTCACAGCACCTTGGAGAGGAGTTGCAAGGGTTCTGGGATAAAGAAGT<br>TTTAAGAGCTGAGAATGACGCACAGAAGCCTTCTTTAACAAGAGCAATCATAAAGTGTTACTGGAAAT<br>CTTATTTAGTTTTGGGAATTTTTACGTTAATTGAGGAAAGTGCCAAAGTAATCCAGCCCATATTTTTG<br>GGAAAAATTATTAATTATTTTGAAAATTATGATCCCATGGATTCTGTGGCTTTGAACACAGCGTACGC<br>CTATGCCACGGTGCTGACTTTTTGCACGCTCATTTTGGCTATACTGCATCACTTATATTTTTATCACG<br>TTCAGTGTGCTGGGATGAGGTTACGAGTAGCCATGTGCCATATGATTTATCGGAAGGCACTTCGTCTT<br>AGTAACATGGCCATGGGGAAGACAACCACAGGCCAGATAGTCAATCTGCTGTCCAATGATGTGAACAA<br>GTTTGATCAGGTGACAGTGTTCTTACACTTCCTGTGGGCAGGACCACTGCAGGCGATTGCAGTGACTG<br>CCCTACTCTGGATGGAGATAGGAATATCGTGCCTTGCTGGGATGGCAGTTCTAATCATTCTCCTGCCC<br>TTGCAAAGCTGTTTTGGGAAGTTGTTCTCATCACTGAGGAGTAAAACTGCAACTTTCACGGATGCCAG<br>GATCAGGACCATGAATGAAGTTATAACTGGTATAAGGATAATAAAAATGTACGCCTGGGAAAAGTCAT<br>TTTCAAATCTTATTACCAATTTGAGAAAGAAGGAGATTTCCAAGATTCTGAGAAGTTCCTGCCTCAGA<br>GGGATGAATTTGGCTTCATTTTTCAGTGCAAGCAAAATCATCGTGTTTGTGACCTTCACCACCTACGT<br>GCTCCTCGGCAGTGTGATCACAGCCAGCCGCGTGTTCGTGGCAGTGACGCTGTATGGGGCTGTGCGGC<br>TGACGGTTACCCTCTTCTTCCCCTCAGCCATTGAGAGGGTGTCAGAGGCAATCGTCAGCATCCGAAGA<br>ATCCAGACCTTTTTGCTACTTGATGAGATATCACAGCGCAACCGTCAGCTGCCGTCAGATGGTAAAAA<br>GATGGTGCATGTGCAGGATTTTACTGCTTTTTGGGATAAGGCATCAGAGACCCCAACTCTACAAGGCC<br>TTTCCTTTACTGTCAGACCTGGCGAATTGTTAGCTGTGGTCGGCCCCGTGGGAGCAGGGAAGTCATCA<br>CTGTTAAGTGCCGTGCTCGGGGAATTGGCCCCAAGTCACGGGCTGGTCAGCGTGCATGGAAGAATTGC<br>CTATGTGTCTCAGCAGCCCTGGGTGTTCTCGGGAACTCTGAGGAGTAATATTTTATTTGGGAAGAAAT<br>ACGAAAAGGAACGATATGAAAAAGTCATAAAGGCTTGTGCTCTGAAAAAGGATTTACAGCTGTTGGAG<br>GATGGTGATCTGACTGTGATAGGAGATCGGGGAACCACGCTGAGTGGAGGGCAGAAAGCACGGGTAAA<br>CCTTGCAAGAGCAGTGTATCAAGATGCTGACATCTATCTCCTGGACGATCCTCTCAGTGCAGTAGATG<br>CGGAGTTAGCAGACACTTGTTCGAACTGTGTATTTGTCAAATTTTGCATGAGAAGATCACAATTTTA<br>GTGACTCATCAGTTGCAGTACCTCAAAGCTGCAAGTCAGATTCTGATATTGAAAGATGGTAAAATGGT<br>GCAGAAGGGGACTTACACTGAGTTCCTAAAATCTGGTATAGATTTTGGCTCCCTTTTAAAGAAGGATA<br>ATGAGGAAAGTGAACAACCTCCAGTTCCAGGAACTCCCACACTAAGGAATCGTACCTTCTCAGAGTCT<br>TCGGTTTGGTCTCAACAATCTTCTAGAACTTCCTTGAAAGATGGTGCTCTGGAGAGCCAAGATACAGA<br>GAATGTCCCAGTTACACTATCAGAGGAGAACCGTTCTGAAGGAAAAGTTGGTTTTCAGGCCTATAAGA<br>ATTACTTCAGAGCTGGTGCTCACTGGATTGTCTTCATTTTCCTTATTCTCCTAAACACTGCAGCTC<br>AGGTTGCCTATGTGCTTCAAGATTGGTGGCTTTCATACTGGGCAAACAAACAAAGTATGCTAAATGTC<br>ACTGTAAATGGAGGAGGAAATGTAACCGAGAAGCTAGATCTTAACTGGTACTTAGGAATTTATTCAGG<br>TTTAACTGTAGCTACCGTTCTTTTTGGCATAGCAAGATCTCTATTGGTATTCTACGTCCTTGTTAACT<br>CTTCACAAACTTTGCACAACAAAATGTTTGAGTCAATTCTGAAAGCTCCGGTATTATTCTTTGATAGA<br>AATCCAATAGGAAGAATTTTAAATCGTTTCTCCAAAGACATTGGACACTTGGATGATTTGCTGCCGCT<br>GACGTTTTTAGATTTCATCCAGAGATGGATCTCGCTGTGTTGTCCTGGCTGGTCTCAACCTCCTAGG<br>CTCAAGCAATCCTCCTCCCTCCTCAAGCAAACCTCAGTGCTGGGATTATAGGCATGAGCCACTGTACC<br>TGGCTAAATGTTGTTTTTTTGATATTCAATTTTTGTTTATAGAATTTTCATTTGTTTTGCTCTTATAC<br>TTTTCATCTTTTTATGTTTATTGACCAATTAAATATCATTTGGGTAAGCACCTATTTAAGTGTCTTAA<br>CAATTTTTCTATTGAGTACTCTGGGTTTTTGTTTTGTTTTTCTTACTGATTTGTAGAATTCTTTATGT<br>ATTCTGAATTGCAGATACCTTCCTTCTGTACTAATGCTTATCTTTTTAGCCCTGTAATATTGTGTTTT<br>CATAAACATACTTATCAATCTTT |
| 7185 | Human ABCC4<br>transcript variant<br>3 mRNA<br>NM_001301829.2<br>(GI: 1677530022<br>version 2) | GCTTCACAGGCTCCAGCCGAGCGGACAGGCGTGGCGGCCGGAGCCCCAGCATCCCTGCTTGAGGTCCA<br>GGAGCGGAGCCCGCGGCCACCGCCGCCTGATCAGCGCGACCCCGGCCCGCGCCCGCCCCGCCCGGCAA<br>GATGCTGCCCGTGTACCAGGAGGTGAAGCCCAACCCGCTGCAGGACGCGAACCTCTGCTCACGCGTGT<br>TCTTCTGGTGGCTCAATCCCTTGTTTAAAATTGGCCATAAACGGAGATTAGAGGAAGATGATATGTAT<br>TCAGTGCTGCCAGAAGACCGCTCACAGCACCTTGGAGAGGAGTTGCAAGGGTTCTGGGATAAAGAAGT<br>TTTAAGAGCTGAGAATGACGCACAGAAGCCTTCTTTAACAAGAGCAATCATAAAGTGTTACTGGAAAT<br>CTTATTTAGTTTTGGGAATTTTTACGTTAATTGAGGAAAGTGCCAAAGTAATCCAGCCCATATTTTTG<br>GGAAAAATTATTAATTATTTTGAAAATTATGATCCCATGGATTCTGTGGCTTTGAACACAGCGTACGC<br>CTATGCCACGGTGCTGACTTTTTGCACGCTCATTTTGGCTATACTGCATCACTTATATTTTTATCACG<br>TTCAGTGTGCTGGGATGAGGTTACGAGTAGCCATGTGCCATATGATTTATCGGAAGGCACTTCGTCTT<br>AGTAACATGGCCATGGGGAAGACAACCACAGGCCAGATAGTCAATCTGCTGTCCAATGATGTGAACAA<br>GTTTGATCAGGTGACAGTGTTCTTACACTTCCTGTGGGCAGGACCACTGCAGGCGATTGCAGTGACTG<br>CCCTACTCTGGATGGAGATAGGAATATCGTGCCTTGCTGGGATGGCAGTTCTAATCATTCTCCTGCCC<br>TTGCAAAGCTGTTTTGGGAAGTTGTTCTCATCACTGAGGAGTAAAACTGCAACTTTCACGGATGCCAG<br>GATCAGGACCATGAATGAAGTTATAACTGGTATAAGGATAATAAAAATGTACGCCTGGGAAAAGTCAT<br>TTTCAAATCTTATTACCAATTTGAGAAAGAAGGAGATTTCCAAGATTCTGAGAAGTTCCTGCCTCAGA<br>GGGATGAATTTGGCTTCATTTTTCAGTGCAAGCAAAATCATCGTGTTTGTGACCTTCACCACCTACGT<br>GCTCCTCGGCAGTGTGATCACAGCCAGCCGCGTGTTCGTGGCAGTGACGCTGTATGGGGCTGTGCGGC<br>TGACGGTTACCCTCTTCTTCCCCTCAGCCATTGAGAGGGTGTCAGAGGCAATCGTCAGCATCCGAAGA |

TABLE 14-continued

Target sequences.

| SEQ ID NO: | Description | Sequence |
|---|---|---|
| | | ATCCAGACCTTTTTGCTACTTGATGAGATATCACAGCGCAACCGTCAGCTGCCGTCAGATGGTAAAAA<br>GATGGTGCATGTGCAGGATTTTACTGCTTTTTGGGATAAGGCATCAGAGACCCCAACTCTACAAGGCC<br>TTTCCTTTACTGTCAGACCTGGCGAATTGTTAGCTGTGGTCGGCCCCGTGGGAGCAGGGAAGTCATCA<br>CTGTTAAGTGCCGTGCTCGGGGAATTGGCCCCAAGTCACGGGCTGGTCAGCGTGCATGGGAAGAATTGC<br>CTATGTGTCTCAGCAGCCCTGGGTGTTCTCGGGAACTCTGAGGAGTAATATTTTATTTGGGAAGAAAT<br>ACGAAAAGGAACGATATGAAAAAGTCATAAAGGCTTGTGCTCTGAAAAAGGATTTACAGCTGTTGGAG<br>GATGGTGATCGACTGTGATAGGAGATCGGGGAACCACGCTGAGTGGAGGGCAGAAAGCACGGGTAAA<br>CCTTGCAAGAGCAGTGTATCAAGATGCTGACATCTATCTCCTGGACGATCCTCTCAGTGCAGTAGATG<br>CGGAAGTTAGCAGACACTTGTTCGAACTGTGTATTTGTCAAATTTTGCATGAGAAGATCACAATTTTA<br>GTGACTCATCAGTTGCAGTACCTCAAAGCTGCAAGTCAGATTCTGATATTGAAAGATGGTAAAATGGT<br>GCAGAAGGGGACTTACACTGAGTTCCTAAAATCTGGTATAGATTTTGGCTCCCTTTTAAAGAAGGATA<br>ATGAGGAAAGTGAACAACCTCCAGTTCCAGGAACTCCCACACTAAGGAATCGTACCTTCTCAGAGTCT<br>TCGGTTTGGTCTCAACAATCTTCTAGACCCTCCTTGAAAGATGGTGCTCTGGAGAGCCAAGATGTTGC<br>CTATGTGCTTCAAGATTGGTGGCTTTCATACTGGGCAAACAAACAAAGTATGCTAAATGTCACTGTAA<br>ATGGAGGAGGAAATGTAACCGAGAAGCTAGATCTTAACTGGTACTTAGGAATTTATTCAGGTTTAACT<br>GTAGCTACCGTTCTTTTTGGCATAGCAAGATCTCTATTGGTATTCTACGTCCTTGTTAACTCTTCACA<br>AACTTTGCACAACAAAATGTTTGAGTCAATTCTGAAAGCTCCGGTATTATTCTTTGATAGAAATCCAA<br>TAGGAAGAATTTTAAATCGTTTCTCCAAAGACATTGGACACTTGGATGATTTGCTGCCGCTGACGTTT<br>TTAGATTTCATCCAGACATTGCTACAAGTGGTTGGTGTGGTCTCTGTGGCTGTGGCCGTGATTCCTTG<br>GATCGCAATACCCTTGGTTCCCCTTGGAATCATTTTCATTTTTCTTCGGCGATATTTTTGGAAACGT<br>CAAGAGATGTGAAGCGCTCGGAATCTACAACTCGGAGTCCAGTGTTTTCCCACTTATCATCTTCTCTC<br>CAGGGGCTCTGGACCATCCGGGCATACAAAGCAGAAGAGAGGTGTCAGGAACTGTTTGATGCACACCA<br>GGATTTACATTCAGAGGCTTGGTTCTTGTTTTTGACAACGTCCCGCTGGTTTGCCGTCCGTCTGGATG<br>CCATCTGTGCCATGTTTGTCATCATCGTTGCCTTTGGGTCCCTGATTCTGGCAAAAACTCTGGATGCC<br>GGGCAGGTTGGTTTGGCACTGTCCTATGCCCTCACGCTCATGGGGATGTTTCAGTGGTGTGTTCGACA<br>AAGTGCTGAAGTTGAGAATATGATGATCTCAGTAGAAAGGGTCATTGAATACACAGACCTTGAAAAAG<br>AAGCACCTTGGGAATATCAGAAACGCCCACCACCAGCCTGGCCCCATGAAGGAGTGATAATCTTTGAC<br>AATGTGAACTTCATGTACAGTCCAGGTGGGCCTCTGGTACTGAAGCATCTGACAGCACTCATTAAATC<br>ACAAGAAAAGGTTGGCATTGTGGGAAGAACCGGAGCTGGAAAAAGTTCCCTCATCTCAGCCCTTTTTA<br>GATTGTCAGAACCCGAAGGTAAAATTTGGATTGATAAGATCTTGACAACTGAAATTGGACTTCACGAT<br>TTAAGGAAGAAGATGTCAATCATACCTCAGGAACCTGTTTTGTTCACTGGAACAATGAGGAAAAACCT<br>GGATCCCTTTAATGAGCACACGGATGAGGAACTGTGGAATGCCTTACAAGAGGTACAACTTAAAGAAA<br>CCATTGAAGATCTTCCTGGTAAAATGGATACTGAATTAGCAGAATCAGGATCCAATTTTAGTGTTGGA<br>CAAAGACAACTGGTGTGCCTTGCCAGGGCAATTCTCAGGAAAAATCAGATATTGATTATTGATGAAGC<br>GACGGCAAATGTGGATCCAAGAACTGATGAGTTAATACAAAAAAAAAATCCGGGAGAAATTTGCCCACT<br>GCACCGTGCTAACCATTGCACACAGATTGAACACCATTATTGACAGCGACAAGATAATGGTTTTAGAT<br>TCAGGAAGACTGAAAGAATATGATGAGCCGTATGTTTTGCTGCAAAATAAAGAGAGCCTATTTTACAA<br>GATGGTGCAACAACTGGGCAAGGCAGAAGCCGCTGCCCTCACTGAAACAGCAAAACAGGTATACTTCA<br>AAAGAAATTATCCACATATTGGTCACACTGACCACATGGTTACAAACACTTCCAATGGACAGCCCTCG<br>ACCTTAACTATTTTCGAGACAGCACTGTGAATCAACCAAAATGTCAAGTCCGTTCCGAAGGCATTTT<br>CCACTAGTTTTTGGACTATGTAAACCACATTGTACTTTTTTTACTTTGGCAACAAATATTTATACAT<br>ACAAGATGCTAGTTCATTTGAATATTTCTCCCAACTTATCCAAGGATCTCCAGCTCTAACAAAATGGT<br>TTATTTTTATTTAAATGTCAATAGTTGTTTTTTAAAATCCAAATCAGAGGTGCAGGCCACCAGTTAAA<br>TGCCGTCTATCAGGTTTTGTGCCTTAAGAGACTACAGAGTCAAAGCTCATTTTTAAGGAGTAGGACA<br>AAGTTGTCACAGGTTTTTGTTGTTGTTTTATTGCCCCCAAAATTACATGTTAATTTCCATTTATATC<br>AGGGATTCTATTTACTTGAAGACTGTGAAGTTGCCATTTTGTCTCATTGTTTTCTTTGACATAACTAG<br>GATCCATTATTTCCCCTGAAAGGCTTCTTGTTAGAAAATAGTACAGTTACAACCAATAGGAACAACAAA<br>AAGAAAAGTTTGTGACATTGTAGTAGGGAGTGTGTACCCCTTACTCCCCATCAAAAAAAAAAATGGA<br>TACATGGTTAAAGGATAGAAGGGCAATATTTTATCATATGTTCTAAAAGAGAAGGAAGAGAAAATACT<br>ACTTTCTCAAAATGGAAGCCCTTAAAGGTGCTTTGATACTGAAGGACACAAATGTGACCGTCCATCCT<br>CCTTTAGAGTTGCATGACTTGGACACGGTAACTGTTGCAGTTTTAGACTCAGCATTGTGACACTTCCC<br>AAGAAGGCCAAACCTCTAACCGACATTCCTGAAATACGTGGCATTATTCTTTTTTGGATTTCTCATTT<br>ATGGAAGGCTAACCCTCTGTTGACTGTAAGCCTTTTGGTTTGGGCTGTATTGAAATCCTTTCTAAATT<br>GCATGAATAGGCTCTGCTAACGTGATGAGACAAACTGAAAATTATTGCAAGCATTGACTATAATTATG<br>CAGTACGTTCTCAGGATGCATCCAGGGGTTCATTTTCATGAGCCTGTCCAGGTTAGTTTACTCCTGAC<br>CACTAATAGCATTGTCATTTGGGCTTTCTGTTGAATGAATCAACAAACCACAATACTTCCTGGGACCT<br>TTTGTACTTTATTTGAACTATGAGTCTTTAATTTTTCCTGATGATGGTGGCTGTAATATGTTGAGTTC<br>AGTTTACTAAAGGTTTTACTATTATGGTTTGAAGTGGAGTCTCATGACCTCTCAGAATAAGGTGTCAC<br>CTCCCTGAAATTGCATATATGTATATAGACATGCACACGTGTGCATTTGTTTGTATACATATATTTGT<br>CCTTCGTATAGCAAGTTTTTTGCTCATCAGCAGAGAGCAACAGATGTTTATTGAGTGAAGCCTTAAA<br>AAGCACACACCACACACAGCTAACTGCCAAAATACATTGACCGTAGTAGCTGTTCAACTCCTAGTACT<br>TAGAAATACACGTATGGTTAATGTTCAGTCCAACAAACCACACACAGTAAATGTTTATTAATAGTCAT<br>GGTTCGTATTTTAGGTGACTGAAATTGCATCAGTGATCATAATGGGTTTGTTAAAACGATAGCTATA<br>TTCAAAATGTCTATATGTTATTTGGACTTTTGAGGTTAAAGACAGTCATATAAACGTCCTGTTTCTG<br>TTTTAATGTTATCATAGAATTTTTAATGAAACTAAATTCAATTGAAATAAATGATAGTTTTCATCTC<br>CA |
| 7186 | Human ABCC4<br>transcript variant<br>4 mRNA<br>NM_001301830.2<br>(GI: 1677498275<br>version 2) | GCTTCACAGGCTCCAGCCGAGCGGACAGGCGTGGCGGCCGGAGCCCCAGCATCCCTGCTTGAGGTCCA<br>GGAGCGGAGCCCGCGGCCACCGCCGCCTGATCAGCGCGACCCCGGCCCGCGCCCGCCCGGCAA<br>GATGCTGCCCGTGTACCAGGAGGTGAAGCCCAACCCGCTGCAGGACGCGAACCTCTGCTCACGCGTGT<br>TCTTCTGGTGGCTCAATCCCTTCTTGTTTAAAATTGGCCATAAACGGAGATTAGAGGAAGATGATATT<br>TCAGTGCTGCCAGAAGACCGCTCACAGCACCTTGGAGAGGAGTTGCAAGGGTTCTGGGATAAAGAAGT<br>TTTAAGAGCTGAGAATGACCACAGAAGCCTTCTTTAACAAGAGCAATCATAAAGTGTTACTGGAAAT<br>CTTATTTAGTTTTGGGAATTTTTACGTTAATTGAGGCACTTCGTCTTAGTAACATGGCCATGGGGAAG<br>ACAACCACAGGCCAGATAGTCAATCTGCTGTCCAATGATGTGAACAAGTTTGATCAGGTGACAGTGTT<br>CTTACACTTCCTGTGGGCAGGACCACTGCAGGCGATTGCAGTGACTGCCCTACTCTGGATGGAGATAG |

TABLE 14-continued

Target sequences.

| SEQ ID NO: | Description | Sequence |
|---|---|---|
| | | GAATATCGTGCCTTGCTGGGATGGCAGTTCTAATCATTCTCCTGCCCTTGCAAAGCTGTTTTGGGAAG<br>TTGTTCTCATCACTGAGGAGTAAAACTGCAACTTTCACGGATGCCAGGATCAGGACCATGAATGAAGT<br>TATAACTGGTATAAGGATAATAAAAATGTACGCCTGGGAAAAGTCATTTTCAAATCTTATTACCAATT<br>TGAGAAGAAGGAGATTTCCAAGATTCTGAGAAGTTCCTGCCTCAGAGGGATGAATTTGGCTTCATTT<br>TTCAGTGCAAGCAAAATCATCGTGTTTGTGACCTTCACCACCTACGTGCTCCTCGGCAGTGTGATCAC<br>AGCCAGCCGCGTGTTCGTGGCAGTGACGCTGTATGGGGCGTGTCGGCTGACGGTTACCCTCTTCTTCC<br>CCTCAGCCATTGAGAGGGTGTCAGAGGCAATCGTCAGCATCCGAAGAATCCAGACCTTTTTGCTACTT<br>GATGAGATATCACAGCGCAACCGTCAGCTGCCGTCAGATGGTAAAAAGATGGTGCATGTGCAGGATTT<br>TACTGCTTTTTGGGATAAGGCATCAGAGACCCCAACTCTACAAGGCCTTTCCTTTACTGTCAGACCTG<br>GCGAATTGTTAGCTGTGGTCGGCCCCGTGGGAGCAGGGAAGTCATCACTGTTAAGTGCCGTGCTCGGG<br>GAATTGGCCCCAAGTCACGGGCTGGTCAGCGTGCATGGAAGAATTGCCTATGTGTCTCAGCAGCCCTG<br>GGTGTTCTCGGGAACTCTGAGGAGTAATATTTTATTTGGGAAGAAATACGAAAAGGAACGATATGAAA<br>AAGTCATAAAGGCTTGTGCTCTGAAAAAGGATTTACAGCTGTTGGAGGATGGTGATCTGACTGTGATA<br>GGAGATCGGGGAACCACGCTGAGTGGAGGGCAGAAAGCACGGGTAAACCTTGCAAGAGCAGTGTATCA<br>AGATGCTGACATCTATCTCCTGGACGATCCTCTCAGTCAGTAGATGCGGAAGTTAGCAGACACTTGT<br>TCGAACTGTGTATTTGTCAAATTTTGCATGAGAAGATCACAATTTTAGTGACTCATCAGTTGCAGTAC<br>CTCAAAGCTGCAAGTCAGATTCTGATATTGAAAGATGGTAAAATGGTGCAGAAGGGGACTTACACTGA<br>GTTCCTAAAATCTGGTATAGATTTTGGCTCCCTTTTAAAGAAGGATAATGAGGAAAGTGAACAACCTC<br>CAGTTCCAGGAACTCCCACACTAAGGAATCGTACCTTCTCAGAGTCTTCGGTTTGGTCTCAACAATCT<br>TCTAGACCCTCCTTGAAAGATGGTGCTCTGGAGAGCCAAGATACAGAGAATGTCCCAGTTACACTATC<br>AGAGGGAGAACCGTTCTGAAGGAAAAGTTGGTTTTCAGGCCTATAAGAATTACTTTGGGTCTGGTGCTC<br>ACTGGATTGTCTTCATTTTCCTTATTCTCCTAAACACTGCAGCTCAGGTTGCCTATGTGCTTCAAGAT<br>TGGTGGCTTTCATACTGGGCAAACAAACAAAGTATGCTAAATGTCACTGTAAATGGAGGAGGAAATGT<br>AACCGAGAAGCTAGATCTTAACTGGTACTTAGGAATTTATTCAGGTTTAACTGTAGCTACCGTTCTTT<br>TTGGCATAGCAAGATCTCTATTGGTATTCTACGTCCTTGTTAACTCTTCACAAACTTTGCACAACAAA<br>ATGTTTGAGTCAATTCTGAAAGCTCCGGTATTATTCTTTGATAGAAATCCAATAGGAAGAATTTTAAA<br>TCGTTTCTCCAAAGACATTGGACACTTGGATGATTTGCTGCCGCTGACGTTTTTAGATTTCATCCAGA<br>GATGGGATCTCGCTGTGTTGTCCTGGCTGGTCTCAAACTCCTAGGCTCAAGCAATCCTCCTCCCTCCT<br>CAAGCAAACCTCAGTGCTGGGATTATAGGCATGAGCCACTGTACCTGGCTAAATGTTGTTTTTTGAT<br>ATTCAATTTTTGTTTATAGAATTTTCATTTGTTTTGCTCTTATACTTTTCATCTTTTTATGTTTATTG<br>ACCAATTAAATATCATTTGGGTAAGCACCTATTTAAGTGTCTTAACAATTTTTCTATTGAGTACTCTG<br>GGTTTTTGTTTTGTTTTTCTTACTGATTTGTAGAATTCTTTATGTATTCTGAATTGCAGATACCTTCC<br>TTCTGTACTAATGCTTATCTTTTAGCCCTGTAATATTGTGTTTTCATAAACATACTTATCAATCTTT |
| 7187 | Human PAK3<br>transcript variant<br>1 mRNA<br>NM_001128166.3<br>(GI: 1889680926<br>version 3) | AGAGCATCCTCAGCAGCTGCCACCGAAGCAGCCTCCTCCTTCTCTCTTCCTCCTCCTCCTACCACGGC<br>CGCCGCCACCACCGCTGCGGCTGTGATCTCCTATCCCCTCTGGTCCTCCTTCCTCCCCCAGTTCCTGC<br>TCCTCCTCCCATCCCCTGCTCCTCCTGCCCAGCAGCGAAGGGCAGAACCCTCGGCTGCCGCCCTCCTT<br>CGCTCTGACCAAGAAGCAGCTGGAACAGAATAACATACAGAGGACAGCTTTCTTCTTCTGAGGAGTCAG<br>AAGTTCAGTTCGCCCAACATGGAATGACTTGAGGAGCTGTGAAATTAGTTGTAACTGAAAATGTCTGA<br>CGGTCTGGATAATGAAGAGAAACCCCCGGCTCCTCCACTGAGGATGAATAGTAACAACCGGGATTCTT<br>CAGCACTCAACCACAGCTCCAAACCACTTCCCATGGCCCCTGAAGAGAAGAATAAGAAAGCCAGGCTT<br>CGCTCTATCTTCCCAGGAGGAGGGGATAAAACAATAAGAAGGAGAAGGAGAAAGAGCGCCCAGAGATCTC<br>TCTTCCTTCAGACTTTGAGCATACGATTCATGTGGGGTTTGATGCAGTCACCGGGGAATTCACTGGAA<br>TTCCAGAGCAATGGGCACGATTACTCCAAACTTCCAACATAACAAAATTGGAACAGAAGAAGAACCCA<br>CAAGCTGTTCTAGATGTTCTCAAATTCTATGATTCCAAAGAAACAGTCAACAACCAGAAATACATGAG<br>CTTTACATCAGGAGATAAAAGTGCACATGGATACATAGCAGCCCATCCTTCGAGTACAAAAACAGCAT<br>CTGAGCCTCCATTGGCCCCTCCTGTGTCTGAAGAAGAAGATGAAGAGGAAGAAGAAGAAGAAGATGAA<br>AATGAGCCACCACCAGTTATCGCACCAAGACCAGAGCATACAAAATCAATCTATACTCGTTCTGTGGT<br>TGAATCCATTGCTTCACCAGCAGTACCAAATAAAGAGGTCACACCACCCTCTGCTGAAAATGCCAATT<br>CCAGTACTTTGTACAGGAACACAGATCGGCAAAGAAAAAATCCAAGATGACAGATGAGGAGATCTTA<br>GAGAAGCTAAGAAGCATTGTGAGTGTTGGGGACCCAAAGAAAAAATACACAAGATTTGAAAAAATTGG<br>TCAAGGGGCATCAGGTACTGTTTATACAGCACTAGACATTGCAACAGGACAAGAGGTGGCCATAAAGC<br>AGATGAACTTCAACAGCAACCCAAGAAGGAATTAATTATTAATGAAATTCTGGTCATGAGGGAAAAT<br>AAGAACCCTAATATTGTTAATTATTTAGATAGCTACCTTGGTGGGTGATGAACTATGGGTAGTCATGGA<br>ATACTTGGCTGGTGGCTCTCTGACTGATGTGGTCACAGAGACCTGTATGGATGAAGGACAGATAGCAG<br>CTGTCTGCAGAGAGTGCCTGCAAGCTTTGGATTTCCTGCACTCAAACCAGGTGATCCATAGAGATATA<br>AAGAGTGACAATATTCTTCTCGGGATGGATGGCTCTGTTAAATTGACTGACTTTGGGTTCTGTGCCCA<br>GATCACTCCTGAGCAAAGTAAACGAAGCACTATGGTGGGAACCCCATATTGGATGGCACCTGAGGTGG<br>TGACTCGAAAAGCTTATGGTCCGAAAGTTGATATCTGGTCTCTTGGAATTATGGCAATTGAAATGGTG<br>GAAGGTGAACCCCCTTACCTTAATGAAAATCCACTCAGGGCATTGTATCTGATAGCCACTAATGGAAC<br>TCCAGAGCTCCAGAATCCTGAGAGACTGTCAGCTGTATTCCGTGACTTTTTAAATCGCTGTCTTGAGA<br>TGGATGTGGATAGGCGAGGATCTGCCAAGGAGCTTTTGCAGCATCCATTTTTAAAATTAGCCAAGCCT<br>CTCTCCAGCCTGACTCCTCTGATTATCGCTGCAAAGGAAGCAATTAAGAACAGCAGCCGCTAAGCCTG<br>CAAGCCTTACACCTCACCATCTCCCTCATGAGTAAGACTGAAATAAAACTCTGCTGCAGGAAAGATGG<br>AAGAAAAGACAGTCAAATGGGTGGGGTTCTTTACCTTTCAAATGAATAGAAACTTCTTATAAGCCT<br>TTTTCCTACTCCCTCAGATTATGTAATTTATTTGTAAGCCTGAATCGCAGCCCAAACAGGGCAGCAAT<br>GTTGAGTGACCATAAAGTGGTCACTTCCACCGTGAAGCGAAAGAGCCAGTAGTGAATCCCCTCATTT<br>TGTGCATTCACTTTGAAGAAAAAGGTTTCTCAAAGATGCACACTCCCTCTTCATAGTGTTGTGTTTGT<br>TTTTAAGTTAGAGAGTAGTCCCTCTTGCATTCAAACCTCCTTCAAAACTCCTTACCCAATGTGATGTT<br>TTTCACTTGCATTGTCATTAGATGTCCAGAAAAAAAAAGATGTCAAAATGTTTTTCTAAAAAAGAA<br>AGCAAAAAAGCAAGGCAAAAAAAACAAACAAACAAACAAACAAAACAAACAAGCAA<br>ACAAAAATACCAGAGCAAGTACTGTGTGAACATGTGGAAGTCCATGCCCTAATAGAGTTGCAATTTT<br>TTATTCTTCTTCTATAGTGGTGGCTTGGTTTGTGTACCTATTTTCTGCATTTGTATTGGAAAGGTT<br>TCTTTTAAGACATTTTCCAAAGTGGAGAGGAATATGTGTGTTCAGGAAGGGCTTTCAAAAAACTGTA<br>TATCTAAATAAAGCTCAAACGGTGAAATCCTGTCACATTTTCACAATGATGCTTAAAAGATAATTGAG<br>TAAACCAGGTTGTTAATCTCCTTAATACCTGAAAGAGGACACACTGAAACTGAAACTGTGACATCCTG |

TABLE 14-continued

Target sequences.

| SEQ ID NO: | Description | Sequence |
|---|---|---|
| | | CTAGGTGAGTTCAGGTTCTGAACCTAGGAAATCCTCATAGGAGAAACCACATTTAAACAAAGATGGGA
CTTTCTCTGAGAGCCAAAACCAGATAAATGTAGAATACTGAAATCCTTGTTGGACATTAAGTAAACAA
AGATAATGATACCTAAATTAATCCTCTCTTGTGCTTATGAAACATATGCACTGTAAAATAGGCATACC
AGGAGGAAATAGATACATTAATCATCATTTACTTATGATACAAATTATTTATTTTGACAATTTATAAC
GTTTAAAAAAGTTTTTTAAAGATCTAGAGAAAGGTGATATAGTAAACATTCAACTCTGTAAGAAATGG
GAGGTCAGTGAAGGCTACATCCCAATCAATATTTGGCTCTAAGTACCTCTTCCCATTTTTCCTATGTA
TCACCTATTTCTGTTTCGGAATATGGTGTGTTCATGCTTAGTTCTTTGGGCTTTTGAATATCAAAAGC
ATATTCATAAATGTCTTGAAATTCTCTCCAGTGGAAAATAATTTTAACTTACAATCATATCCCAAGAA
ATGTCAGTCCGACAGAATTCCTTATATGACTTGGGGAAAATAACAAAATTTGACTACTATTTCACCAT
ATATCTATTTATTAAAAAATTCAACAGTTGGCACTTCCTGAATCTTCTGAGAGTAGAAAAATATCTGC
GGAGTGTCTGTGTAGAAAAGGATATGCCTCTCTTTTGAGTGTATTGACAATTTTGTAAATTACAGAAA
GTTGTTTCTCTAAGCCTTTGAAAAACTAACAATTTGTGTTATAGAAGGCTTCTTAATTTGCAGTATAA
AAGAATCTAAACAGAACTTATGTACATTCAGCCAGAAGGGGAAAAGAGATCAGTTACATAGGCCTCTCT
CCTTCTTTGCCAAGGTACATCCATCCATCTAACCATCCATATATCCACATCTTAAAATGAAAGCACTT
TCTTTAGAGTTTCAGCAAACTATATAGTGTACGTGTTTATGTTCAGGAGATGACCCCACTGGTGTATT
TCCTATTTTCCCTATTGTTTTCTTTGACTGTAAAAGTTGGGAGAGGCTTGACCTCCTCCCCTTGAAAA
TGTCCACAGTGGGATAAAACAACAAATGTGAAAAGAAAATGAAACGGTAATATTAATTTGAAGCATAC
TATGTTATACTTTGCAAAAACGAATCTGGGCCTGTAATTTTTAATGCCACACTGCTCTAATGAGAGAG
AGAGGCCTTAATTTTGATTTCATTTAAAAATAAGTACTTTAAAAAATTTTTCACTCATAGTGCCGGGA
AATTCAATGAAATCCTGGGATGCAAATAAAAATCAGTACATTAGTGACTGTGTCCTGCCAGTGGAGAG
AGCCCAATACCTGGTTAGGAAGCCCTATTCATTAGTTAGCATCCCTTACATGTTGAGGAAGGCCTTTT
TTTGTTGTTATTTTGGAGACCTTGGAGCAGTGACCCTTCAGATCACTGTAGGCAGAGAAATGGCTTCT
CTCTTATGCTTTCAGTTCAGCATATTAACAATGAGGAGCCAGGTACTTCTTTACTACCACTTTGTACC
AAGATTTGATAATAATATATCCCAGGAGGCATTACTTTTATAAATTTGTATTCATGTAAATTTTCAAA
TGAGAACAGCTTCTAAAGCCCCTTCCCTGTATTGGAGAGTTATGTATATTTCTAATAAGTATTAGAAA
GAAGCTGTTTCTCATGCCACAGTGATGCTGAAGGATTCACATTTGGTACAATCGAGTAACTTGAACGC
CAGATTGTTAACAGTTTATTCTCTTTCCCTGGATTTTTAAGCTCATCTTGACACAGGTGAGTCTATCC
AAATCTTTGATGTTGCTAGTGTGCCCTGAGATAACGAGGGCACATCTTTCAATGTTGATTCCAAATG
TCCTGAGTTAGGAATAGGGCAGTGGGAAAGTCAGGGAAGGGTGAGAAGCACAGTAGAGATTATTTATT
TAAAAAAGGAAAGAACGTTAATGTTGTTAGCAAGGATCCAGTGCGTTGTCATAATCCCATGAGGATTT
TCAGATGACACAATCCCCTCAAATCAGTCACCATGTTGGGTAATGACTTCGTTCTTGCTGATCTCGTG
TGTGTGTCATTGTAAATATTTGTGTGTCCATGTTCCATTTTGGCTACTGGATGGCCAAGCCATGTAAG
AAGATTTAACTCAAGTATTTATTCTTTATGTTATTCAGATTTCTTTCAGGCTTGTGAACTGCACCCCA
ATGTTTGAGTTTAACCACCTGATCCTTACATCTATCCCTCCCCGGTGAAGCACATTCCATTGCTAAAA
GAAAAGAAACACGAAATTGCTTCCTGTTGTCTGTATAACTGTTTTGATAGTTTGAGATATTTGTCTA
TAAATGATATTTCTCAGCTCAAAGATCGTGTAAATAATTATATTCCTTTGCTCAATGGGTTTATTTCT
AATGAGGCTGCCAGTTCTGAGAGATTCTATAATATCACTTTTAAATAACATAAACAGGGATTACAACT
ATGTAAAAAGAAATGCATATGGACAAAGACTGGGAACACAGATAATTGAAATCAGTTGTGTTAGGGTG
GTGGAATTATGTGAATTTTTTTTCTTTTTAAAATTTTATTTGATATTGTTATAATATTGCTTTACAA
TAAATAAACAGCAGAAAGGGAACTATAGACACATAGAAAAGATGCCAGAAGCAGATGCCTTCTGGCCA
GAGCGCAGAGCATGCAGGGCAGAGATATTTGCTAGTTACAATTATTCCATAGGCTTTATGCTTGCCTG
GGTGCTGAGGTTGGCACACGCTCGGGTATGGCACACGCTTTCTTAGGAGACTATTATCTATAAGTTAA
AGCTAGGGAGATGTCACTATTAGAACTCCAAACACACTCTTCTGCTTTAAAACAGGTTGTCTGCCCTC
TGCTTTGGTATGGCATTCGGGTGTCTGTTTTGTGGTTGCTTTAGATTGGAGGGGTGACCATTTTATTA
GCCCCCTTGATAACATCTGTTGCAGATATTGCCTTTCTGGAACGTTTTAACAGACTCTCAGGTTGAAT
TTTGGAGGACTAGAAGGATAAAATCCCCAGCTCCCACCATTTTCTTGTCCAACAGGATATTACTGTAT
ATCATTCAGGTAGGATTCTTCTTTTAATAACCAATAGGGCAAGTCCCACTAATTTCAATAGAAGTTAT
GACTTGCAATTAAAAGCTGACTTTGAAATCATTAAACAAATATGTAGGACTGTCTCTGCCTGTTGGCA
TTCAGTTATAGTTCTGTTAATTTTGGCTTGGGATGGTCTCCATGTGCTTTTTTCTGCCTATTTATAGG
TTGTTTGCAGTAGTTGTGATTTTTAAAGAGCAAGGGAGACCATCTAACCAAAGGATAACTTCCTTCTA
ACTCACCAAAGAAATTTTAGGTGAGAACTTTAATAATGAGGTAGTCACCTCAGATATGCTGCTTAGTT
TCACTAAAAGCAGACCCTATACCTAGAGAAGTCACTGGCTTTTTATTGGTCATTCTCAATACAGAAAT
ACTTAGGGGAGTCTTAACCCTGCCATCCCCGGTTGAATCTCTTGGTCTTTATCTAAGCTACTTGCAGT
TAATATTCAGTTAAGCAAAGGTATGGCCAGTAGTGCAAGTATCTCCCAGTCTCTGAGCTCTGAACAAG
AGGACTGAAATTCAGCATTTGTAAACTGACAGTTTGATGGGCTCTGGGATTTGAAGTGAACTCAGCACA
CAATTCTGAACGTGTATTTGCATGTGGACTGGGAAGGAAATAAATGGGAACTTGGAAATAATGGAATA
TTTCTCCTATGAAAGAATTTTTCGTAGAAGATTTGTTTTTGATATAATCTTTCTGTTGGTTAGCTTTT
AGTGTTTTCATTCCTTTTCTGATCCACACTCCTTTAAGTGACCAAATGAATATAACCCAACATGCATT
GGGAATGTGTTTAATATTAAACAATGTCTAACTGAATCTGCAAATGCGGGAACTGAGATATCACCTCC
ATGTGCACACCTGTGTGTACGAGTATTCTATACAACTTGTAGCATTTACTGCCACTTAATTG
GGTTGAACTTGCAAGATAAACTTTTGGAAACTGCTTAGTGCCATCGGAGTCTCCTTTAGAAGCTGCCA
TCAGGCAAATGCTATCCCATAATACCAGCAGTAAGCCTGGCAACATGTTCAACAGATTTAGTACCCAA
GAGGAAATCAACAGCGATAGTAGAGAATGAGTCAGATGTAGTGGGATAAATACTAGCCTAGGAAGAAG
GAGCCCCGGAGTCTAATATGAGCTTTATTACTAAATTGCTATGTGACGCTAGGCAAGTCACTTAACCT
CTCCATGGCTGTTTCCTCATCTGTAAAATAAGTGTATTGGACTAGATGATCCTTAGGGTCTTTCCAAA
AGTCTAACATTCTATGGCATTATAGGTTGCCTTGCAAATTCAGCCTGCTATAGTGATGGCAAATATCA
CGTTTAAGCCTGAGTCTCTTATGTTGCAGTTAAATAAAAGAACTATTGTAAGATGATTTTTAAAATTCA
AGCAAATGGGCCGGGTGCGGTGGCTCATACCTGTAATCCCAGCACTTTGGGAGGCCAAGGCAGGCGGA
TCACCTGAGGTCAGGAGTTCGAGACCAGCCTGACCAACATAGAGAAACCCCATCTCTACTAAAAATAC
AAAATTAGCCGGGTGTGGTGGCGGGCGCCTGTAATCCCAGCTACTTGGGAGGCTGAGGTGGGAGAATC
GCTTGAACCCAGGAGGCGGAGGTTGTGGTGAGCTGAGATCATGCCATTGCAGTCCAGCCTCGGCACA
AGAGTGAAACTTCGTCTCCAAAAAAAAAAACTCAAGCAAATGAAGTTCATAATAATAGGGGATGTTGA
TAAAACTTGTGGCAGCCTTCCAATTCATTTACAGTTGTTTCGTTTTGTTTTGTTTTAATGTCCATTT
TCTGTTGACTGTTCCCAGTTTTCATTTTCCATACAGTCTGTATGTAAAGTCTGGTTTTCATTAAGCTG
TGGCCAGTATTTGCCACTACAACAGAAACACACTGTCACACTTGCTAGAATATAACTGTACTTGAGCT
TCTCCTTTCCTGTGAAGTAGTGCTGGGCTTTCTAGAGTTTAATTCTCAAGTGGCACAAGATAGCAGAG |

TABLE 14-continued

Target sequences.

| SEQ ID NO: | Description | Sequence |
|---|---|---|
| | | CCCATGCATTTTAATGGCTGAGACTGCTAAGAGTGAACCTAAACACTTACAAGTTGCAGAGAGAAATG
AAAAAGTAATTACATGCTATTAGCATTGAGAAATGTTGACAAATTAATTTGTTGGGAACCAAAGATAG
CATTTCTGATGACAACTCCCACAGTGATTGGCCAGTTGTATGATGAGTACACTGCTGGAAAGAGGGTA
AACTGGGAGTTAGTGGATGGTCCCAATGCCCTGCCTACAGCAGAGTGCCAACCAGCCCTGAGTGCAAA
ATTCAAGTTCAATGTGTGTGCTTGTGTGTGGTGTGCTTTATGGACCCGCAAATACCATATTCATTATT
GATGATAAGATCTTCACAGAATCCTGTAGCTACTAATGCATTGAGTTTTTAATCTCAGTACATCAGCC
AGGAGGAGCCAGATCACAGGGTAGTGATGTCTACTGGGATTATACTCATAACATCTACACAAAACAAG
TTGAGAAGGATCCACGTTTTCATTGTTTATCAGAATTGTATCTCATTTGGCTGAGCATTACTTTTGTC
AGAATGTGTTATCTGTAAACCATGTGTAGTGAAATTCTTCTGTAACTTTGGATTAAAGGTATTTATGG
TCTTTTTGTTTGTTTGATTTTTAAGTAAGTTATTTCTTTTGTAGACCTGCTGATGGTATGGTTCCATC
CTTCTGACCTCAGCATCCAATCTTTTTAAGGATTTTTGTTTTCAATATTGTTATTTTAAATTGTGGTT
GAAGCAATAGAAAATTGAAATATGGATTGTGCATGACTGTGTCTTGAGTGTAAAAATATTGCAGTTTG
AAACTTGGACCTAAAGTATTGCAAATAAAAATGACAAACATCAATGA |
| 7188 | Human PAK3
transcript variant
2 mRNA
NM_002578.5
(GI: 1519316149
version 5) | ACCGCGGGCGGGCAGCTGTGCCAGCTAACCGTCTGGGATCTCGCACTGGGGGCTGCAGCTTTTCCCCG
CCTCGAGCCAGTGTGCGGGGGCGGGAGAAGAGCCAGGGGGAGCGGGCTGGGCCCGGGGCTGCGGCTGC
GGCCGCGGGGCTGCGGCTCCCCAGCCCCGCCAGCTGGAGCGCTCGGAGGTAGAGGAAAGGTCTTGACG
GGGTGGCTGGATCCGTGGCAGAATCCAGTTCCAGATTCTAGACTTGAGGGTTCTGGGCTGTTGGTCTG
TAGAAGCGAAGGAGAGAAGGACTCAAATCCAGGCCAAGTGTATGGCTGTCTGAGGTATTGGAACAGAA
GGAGGTCCATTCCTGTTGGTGACAACACCGTGGCCCTGTTCTGGGATGAGCAAGGTGTAAAGGTTTCC
CCCAAGAAAGAGCAGCTGAGTCCTTGCATCTTGTGGCAGCTGGTGTGCCCAGCACTGAGTCTGTAGGA
GCTGAAGCCAGCCCGGACCCTTCTCATGGGCAGTGCCCACCTGTGCTGAAGTCCTGCAGCGGTGGCGG
TGTGAGGAGCTGTGAATTAGTTGTAACTGAAAATGTCTGACGGTCTGGATAATGAAGAGAAACCCCC
GGCTCCTCCACTGAGGATGAATAGTAACAACCGGGATTCTTCAGCACTCAACCACAGCTCCAAACCAC
TTCCCATGGCCCCTGAAGAGAAGAATAAGAAAGCCAGGCTTCGCTCTATCTTCCCAGGAGGAGGGGAT
AAAACCAATAAGAAGAAGGAGAAAGAGCGCCCAGAGATCTCTCTTCCTTCAGACTTTGAGCATACGAT
TCATGTGGGGTTTGATGCAGTCACCGGGGAATTCACTGGAATTCCAGAGCAATGGGCACGATTACTCC
AAACTTCCAACATAACAAAATTGGAACAGAAGAAGAACCCACAAGCTGTTCTAGATGTTCTCAAATTC
TATGATTCCAAAGAAACAGTCAACAACCAGAAATACATGAGCTTTCATCAGGAGATAAAAGTGCACA
TGGATACATAGCAGCCCATCCTTCGAGTACAAAAACAGCATCTGAGCCTCCATTGGCCCCTCCTGTGT
CTGAAGAAGAAGATGAAGAGGAAGAAGAAGAAGATGAAAATGAGCCACCACCAGTTATCGCACCA
AGACCAGAGCATACAAAATCAATCTATACTCGTTCTGTGGTTAATCCATTGCTTCACCAGCAGTACC
AAATAAAGAGGTCACACCACCCTCTGCTGAAAATGCCAATTCCAGTACTTTGTACAGGAACACAGATC
GGCAAGAAAAAAATCCAAGATGACAGATGAGGAGATCTTAGAGAAGCTAAGAAGCATTGTGAGTGTT
GGGGACCCAAAGAAAAAATACACAAGATTTGAAAAAATTGGTCAAGGGGCATCAGGTACTGTTTATAC
AGCACTAGACATTGCAACAGGACAAGAGGTGGCCATAAAGCAGATGAACCTTCAACAGCAACCCAAGA
AGGAATTAATTATTAATGAAATTCTGGTCATGAGGGAAAATAAGAACCCTAATATTGTTAATTATTTA
GATAGCTACTTGGTGGGTGATGAACTATGGGTAGTCATGGAATACTTGGCTGGTGGCTCTCTGACTGA
TGTGGTCACAGAGACCTGTATGGATGAAGGACAGATAGCAGCTGTCTGCAGAGAGTGCCTGCAAGCTT
TGGATTTCCTGCACTCAAACCAGGTGATCCATAGAGATATAAAGAGTGACAATATTCTTCTCGGGATG
GATGGCTCTGTTAAATTGACTGACTTTGGGTTCTGTGCCCAGATCACTCCTGAGCAAAGTAAACGAAG
CACTATGGTGGGAACCCCATATTGGATGCCAGAGGTGGTGACTCGAAAAGCTTATGGTCCGAAAG
TTGATATCTGGTCTCTTGGAATTATGGCAATTGAAATGGTGGAAGGTGAACCCCCTTACCTTAATGAA
AATCCACTCAGGGCATTGTATCTGATAGCCACTAATGGAACTCCAGAGCTCCAGAATCCTGAGAGACT
GTCAGCTGTATTCCGTGACTTTTTAAATCGCTGTCTTGAGATGGATGTGGATAGGCGAGGATCTGCCA
AGGAGCTTTTGCAGCATCCATTTTTAAAATTAGCCAAGCCTCTCTCCAGCCTGACTCCTCTGATTATC
GCTGCAAAGGAAGCAATTAAGAACAGCAGCCGCTAAGACTGCAAGCCTTACACCTCACCATCTCCCTC
ATGAGTAAGACTGAAATAAAACTCTGCTGCAGGAAAGATGGAAGAAAGACAGTCAAATGGGGTGG
GGGTTCTTTACCTTTCAAATGAATAGAAACTTCTTATAAGCCTTTTTCCTACTCCCTCAGATTATGTA
ATTTATTTGTAAGCCTGAATCGCAGCCCAAACAGGGCAGCAATGTTGAAGTGACCATAAAGTGGTCAC
TTCCACCGTGAAGCGAAAGAGCCAGTAGTGAATCCCCTCATTTTGTGCATTCACTTTGAAGAAAAAGG
TTTCTCAAAGATGCACACTCCCTCTTCATAGTGTTGTGTTTGTTTTTAAGTTAGAGAGTAGTCCCTCT
TGCATTCAAACCTCCTTCAAAACTCCTTACCCAATGTGATGTTTTTCACTTGCATTGTCATTAGATGT
CCAGAAAAAAAAAGATGTCAAATGTTTTTCTAAAAAAAAGAAAGCAAAAAAGCAAGGCAAAAAAAA
AAAAAAAAACAAACAAAAACAAAACAAAACAAACAAGCAAACAAAAATACCAGAGCAAGTACTG
TGTGAACATGTGGAAGTCCATGCCCTAATAGAGTTGCAATTTTTATTCTTCTTCTATAGTGGTGGCT
TGGTTTGTGTACCTATTTTTCTGCATTTGTATTGGAAAAGGTTTCTTTTAAGCATTTTCCAAAAGTG
GAGAGGAAATATGTGTTCAGGAAGGGCTTTCAAAAAACTGTATATCTAAATAAAGCTCAAACGGTA
AATCCTGTCACATTTTCACAATGATGCTTAAAAGATAATTGAGTAAACCAGGTTGTTAATCTCCTTAA
TACCTGAAAGAGGACACACTGAAACTGAAACTGTGACATCCTGCTAGGTGAGTTCAGGTTCTGAACCT
AGGAAATCCTCATAGGAGAAACCACATTTAAACAAAGATGGGACTTTCTCTGAGAGCCAAAACCAGAT
AAATGTAGAATACTGAAATCCTTGTTGGACATTAAGTAAACAAAGATAATGATACCTAAATTAATCCT
CTCTTGTGCTTATGAAACATATGCACTGTAAAATAGGCATACCAGGAGGAAATAGATACATTAATCAT
CATTTACTTATGATACAAATTATTTATTTTGACAATTTATAACGTTTAAAAAAGTTTTTTAAAGATCT
AGAGAAAGGTGATATAGTAAACATTCAACTCTGTAAGAAATGGGAGGTCAGTGAAGGCTACATCCCAA
TCAATATTTGGCTCTAAGTACCTCTTCCCATTTTTCCTATGTATCACCTATTTCTGTTTCGGAATATG
GTGTGTTCATGCTTAGTTCTTTGGGCTTTTGAATATCAAAAGCATATTCATAAATGTCTTGAAATTCT
CTCCAGTGGAAATAATTTTAACTTACAATCATATCCCAAGAAATGTCAGTCCGACAGAATTCCTTAT
ATGACTTGGGGAAAATAACAAATTTGACTACTATTTCACCCATATATCTATTTATTAAAAAATTCAAC
AGTTGGCACTTCCTGAATCTTCTGAGAGTAGAAAAATATCTGCGGAGTGTCTGTGTAGAAAAGGATAT
GCCTCTCTTTGAGTGTATTGACAATTTGTAAATTACAGAAAGTTGTTTCTCTAAGCCTTTGAAAAA
CTAACAATTTGTGTTATAGAAGGCTTCTTAATTTGCAGTATAAAAGAATCTAAACAGAACTTATGTAC
ATTCAGCCAGAAGGGAAAGAGATCAGTTACATAGGCCTCTCTCCTTCTTTGCCAAGGTACATCCATC
CATCTAACCATCCATATATCCACATCTTAAAATGAAAGCACTTTCTTTAGAGTTTCAGCAAACTATAT
AGTGTACGTGTTTATGTTCAGGAGATGACCCCACTGGTGTATTTCCTATTTTCCCTATTGTTTTCTTT
GACTGTAAAAGTTGGGAGAGGCTTGACCTCCTCCCCCTTGAAAATGTCCACAGTGGGATAAAACAACAA |

TABLE 14-continued

Target sequences.

| SEQ ID NO: | Description | Sequence |
|---|---|---|
| | | ATGTGAAAAGAAAATGAAACGGTAATATTAATTTGAAGCATACTATGTTATACTTTGCAAAAACGAAT<br>CTGGGCCTGTAATTTTTAATGCCACACTGCTCTAATGAGAGAGAGAGGCCTTAATTTTGATTTCATTT<br>AAAAATAAGTACTTTAAAAAATTTTTCACTCATAGTGCCGGGAAATTCAATGAAATCCTGGGATGCAA<br>ATAAAAATCAGTACATTAGTGACTGTGTCCTGCCAGTGGAGAGAGCCCAATACCTGGTTAGGAAGCCC<br>TATTCATTAGTTAGCATCCCTTACATGTTGAGAAGGCCTTTTTTTTGTTGTTATTTTGGAGACCTTGG<br>AGCAGTGACCCTTCAGATCACTGTAGGCAGAGAAATGGCTTCTCTCTTATGCTTTCAGTTCAGCATAT<br>TAACAATGAGGAGCCAGGTACTTCTTTACTACCACTTTGTACCAAGATTTGATAATAATATATCCCAG<br>GAGGCATTACTTTTATAAATTTGTATTCATGTAAATTTTCAAATGAGAACAGCTTCTAAAGCCCCTTC<br>CCTGTATTGGAGAGTTATGTATATTTCTAATAAGTATTAGAAAGAAGCTGTTTCTCATGCCACAGTGA<br>TGCTGAAGGATTCACATTTGGTACAATCGAGTAACTTGAACGCCAGATTGTTAACAGTTTATTCTCTT<br>TCCCTGGATTTTTAAGCTCATCTTGACACAGGTGAGTCTATCCAAATCTTTGATGTTGCTAGTGTGCC<br>CTGAGATAACGAGGGCACATCTTTCAATGTTGATTCCAAAATGTCCTGAGTTAGGAATAGGGCAGTGG<br>GAAAGTCAGGGAAGGGTGAGAAGCACAGTAGAGATTATTTATTTAAAAAAGGAAAGAACGTTAATGTT<br>GTTAGCAAGGATCCAGTGCGTTGTCATAATCCCATGAGGATTTTCAGATGACACAATCCCCTCAAATC<br>AGTCACCATGTTGGGTAATGACTTCGTTCTTGCTGATCTCGTGTGTGTGTCATTGTAAATATTTGTGT<br>GTCCATGTTCCATTTTGGCTACTGGATGGCCAAGCCATGTAAGAAGATTTAACTCAAGTATTTATTCT<br>TTATGTTATTCAGATTTCTTTCAGGCTTGTGAACTGCACCCCAATGTTTGAGTTTAACCACCTGATCC<br>TTACATCTATCCCTCCCCGGTGAAGCACATTCCATTGCTAAAAGAAAAAGAAACACGAAATTGCTTCC<br>TGTTGTCTGTATAACTGTTTTGATAGTTTGAGATATTTGTCTATAAATGATATTTCTCAGCTCAAAGA<br>TCGTGTAAATAATTATATTCCTTTGCTCAATGGGTTTATTTCTAATGAGGCTGCCAGTTCTGAGAGAT<br>TCTATAATATCACTTTTAAATAACATAAACAGGGATTACAACTATGTAAAAAGAAATGCATATGGACA<br>AAGACTGGGAACACAGATAATTGAAATCAGTTGTGTTAGGGTGGTGGAATTATGTGAATTTTTTTTTC<br>TTTTTAAAATTTTATTTGATATTGTTATAATATTGCTTTACAATAAATAAACAGCAGAAAGGGAACTA<br>TAGACACATAGAAAAGATGCCAGAAGCAGATGCCTTCTGGCCAGAGCGCAGAGCATGCAGGGCAGAGA<br>TATTTGCTAGTTACAATTATTCCATAGGCTTTATGCTTGCCTGGGTGCTGAGGTTGGCACACGCTCGG<br>GTATGGCACACGCTTTCTTAGGGAGACTATTATCTATAAGTTAAAGCTAGGGAGATGTCACTATTAGAA<br>CTCCAAACACACTCTTCTGCTTTAAAACAGGTTGTCTGCCCTCTGCTTTGGTATGGCATTCGGGTGTC<br>TGTTTTGTGGTTGCTTTAGATTGGAGGGGTGACCATTTTATTAGCCCCCTTGATAACATCTGTTGCAG<br>ATATTGCCTTTCTGGAACGTTTTAACAGACTCTCAGGTTGAATTTTGGAGGACTAGAAGGATAAAATC<br>CCCAGCTCCCACCATTTTCTTGTCCAACAGGATATTACTGTATATCATTCAGGTAGGATTCTTCTTTT<br>AATAACCAATAGGGCAAGTCCCACTAATTTCAATAGAAGTTATGACTTGCAATTAAAAGCTGACTTTG<br>AAATCATTAAACAAATATGTAGGACTGTCTCTGCCTGTTGGCATTCAGTTATAGTTCTGTTAATTTTG<br>GCTTGGGATGGTCTCCATGTGCTTTTTTCTGCCTATTTATAGGTTGTTTGCAGTAGTTGTGATTTTTA<br>AAGAGCAAGGGAGACCATCTAACCAAAGGATAACTTCCTTCTAACTCACCAAAGAAATTTTAGGTGAG<br>AACTTTAATAATGAGGTAGTCACCTCAGATATGCTGCTTAGTTTCACTAAAAGCAGACCCTATACCTA<br>GAGAAGTCACTGGCTTTTTATTGGTCATTCTCAATACAGAAATACTTAGGGGAGTCTTAACCCTGCCA<br>TCCCCGGTTGAATCTCTTGGTCTTTATCTAAGCTACTTGCAGTTAATATTCAGTTAAGCAAAGGTATG<br>GCCAGTAGTGCAAGTATCTCCCAGTCTCTGAGCTCTGAACAAGAGGACTGAAATTCAGCATTTGTAAA<br>CTGACAGTTTGATGGGCCTGGGATTTGAAGTGAACTCAGCACACAATTCTGAACGTGTATTTGCATGT<br>GGACTGGGAAGGAAATAAATGGGAACTTGGAAATAATGGAATATTTCTCCTATGAAGAATTTTTCGT<br>AGAAGATTTGTTTTTGATATAATCTTTCTGTTGGTTAGCTTTTAGTGTTTTCATTCCTTTTCTGATCC<br>ACACTCCTTTAAGTGACCAAATGAATATAACCCAACATGCATTGGGAATGTGTTTAATATTAAACAAT<br>GTCTAACTGAATCTGCAAATGCGGGAACTGAGATATCACCTCCATGTGCACACCTGTGTGTACGAGTA<br>TTCTATACAACTTGTAGCATTTACTGCCACTTAATTGGGTTGAACTTGCAAGATAAACTTTTGGAAAC<br>TGCTTAGTGCCATCGGAGTCTCCTTTAGAAGCTGCCATCAGGCAAATGCTATCCCATAATACCAGCAG<br>TAAGCCTGGCAACATGTTCAACAGATTTAGTACCCAAGAGGAAATCAACAGCGATAGTAGAGAATGAG<br>TCAGATGTAGTGGGATAAATACTAGCGTAGGAAGAAGGAGCCCCGGAGTCTAATATGAGCTTTATTAC<br>TAAATTGCTATGTGACGCTAGGCAAGTCACTTAACCTCTCCATGGCTGTTTCCTCATCTGTAAAATAA<br>GTGTATTGGACTAGATGATCCTTAGGGTCTTTCCAAAAGTCTAACATTCTATGGCATTATAGGTTGCC<br>TTGCAAATTCAGCCTGCTATAGTGATGGCAAATATCACGTTTAAGCCTGAGTCTCTTATGTTGCAGTT<br>AAATAAAAGAACTATGTAAGATGATTTTTAAAATTCAAGCAAATGGGCCGGGTGCGGTGGCTCATACC<br>TGTAATCCCAGCACTTTGGGAGGCCAAGGCAGGCGGATCACCTGAGGTCAGGAGTTCGAGACCAGCCT<br>GACCAACATAGAGAAACCCCATCTCTACTAAAAATACAAAATTAGCCGGGTGTGGTGGCGGGCGCCTG<br>TAATCCCAGCTACTTGGGAGGCTGAGGTGGGAGAATCGCTTGAACCCAGGAGGCGGAGGTTGTGGTGA<br>GCTGAGATCATGCCATTGCACTCCAGCCTCGGCAACAAGAGTGAAACTTCGTCTCCAAAAAAAAAAAC<br>TCAAGCAAATGAAGTTCATAATAATAGGGGATGTTGATAAAACTTGTGGCAGCCTTCCAATTCATTTA<br>CAGTTGTTTCGTTTTGTTTTTGTTTAATGTCCATTTTCTGTTGACTGTTCCCAGTTTTCATTTTCCA<br>TACAGTCTGTATGTAAAGTCTGGTTTTCATTAAGCTGTGGCCAGTATTTGCCACTACAACAGAAACAC<br>ACTGTCACACTTGCTAGAATATAACTGTACTTGAGCTTCTCCTTTCCTGTGAAGTAGTGCTGGGCTTT<br>CTAGAGTTTAATTCTCAAGTGGCACAAGATAGCAGAGCCCATGCATTTTAATGGCTGAGACTGCTAAG<br>AGTGAACCTAAACACTTACAAGTTGCAGAGAGAAATGAAAAGTAATTACATGCTATTAGCATTGAGA<br>AATGTTGACAAATTAATTTGTTGGGAACCAAAGATAGCATTTCTGATGACAACTCCCACAGTGATTGG<br>CCAGTTGTATGATGAGTACACTGCTGGAAAGAGGGTAAACTGGGAGTTAGTGGATGGTCCCAATGCCC<br>TGCCTACAGCAGAGTGCCAACCAGCCCTGAGTGCAAAATTCAAGTTCAATGTGTGTGCTTGTGTGTGG<br>TGTGCTTTATGGACCCGCAAATACCCATATTCATTATTGATGATAAGATCTTCACAGAATCCTGTAGCT<br>ACTAATGCATTGAGTTTTTAATCTCAGTACATCAGCCAGGAGGAGCCAGATCACAGGGTAGTGATGTC<br>TACTGGGATTATACTCATAACATCTACACAAAACAAGTTGAGAAGGATCCACGTTTTCATTGTTTATC<br>AGAATTGTATCTCATTTGGCTGAGCATTACTTTTGTCAGAATGTGTTATCTGTAAACCATGTGTAGTG<br>AAATTCTTCTGTAACTTTGGATTAAAGGTATTTATGGTCTTTTTGTTTGTTTGATTTTTAAGTAAGTT<br>ATTTCTTTTGTAGACCTGCTGATGGTATGGTTCCATCCTTCTGACCTCAGCATCCAATCTTTTTAAGG<br>ATTTTTGTTTCAATATTGTTATTTTAAATTGTGGTTGAAGCAATAGAAAATTGAAATATGGATTGTG<br>CATGACTGTGTCTTGAGTGTAAAAATATTGCAGTTTGAAACTTGGACCTAAAGTATTGCAAATAAAAA<br>TGACAAACATCAATGA |

TABLE 14-continued

Target sequences.

| SEQ ID NO: | Description | Sequence |
|---|---|---|
| 7189 | Human PAK3 transcript variant 3 mRNA NM_001128167.3 (GI: 1890283404 version 3) | AGAGCATCCTCAGCAGCTGCCACCGAAGCAGCCTCCTCCTTCTCTCTTCCTCCTCCTCCTACCACGGC<br>CGCCGCCACCACCGCTGCGGCTGTGATCTCCTATCCCCTCTGGTCCTCCTTCCTCCCCCAGTTCCTGC<br>TCCTCCTCCCATCCCCTGCTCCTCCTGCCCAGCAGCGAAGGGCAGAACCCTCGGCTGCCGCCCTCCTT<br>CGCTCTGACCAAGAAGAGGCTGGAACAGGAGCTGTGAAATTAGTTGTAACTGAAAATGTCTGACGGTC<br>TGGATAATGAAGAGAAACCCCGGCTCCTCCACTGAGGATGAATAGTAACAACCGGGATTCTTCAGCA<br>CTCAACCACAGCTCCAAACCACTTCCCATGGCCCCTGAAGAGAAGAATAAGAAAGCCAGGCTTCGCTC<br>TATCTTCCCAGGAGGAGGGGATAAAACCAATAAGAAGAAGGAGAAAGAGCGCCCAGAGATCTCTCTTC<br>CTTCAGACTTTGAGCATACGATTCATGTGGGGTTTGATGCAGTCACCGGGGAATTCACTGGAATTCCA<br>GAGCAATGGGCACGATTACTCCAAACTTCCAACATAACAAAATTGGAACAGAAGAAGAACCCACAAGC<br>TGTTCTAGATGTTCTCAAATTCTATGATTCCAAAGAAACAGTCAACAACCAGAAATACATGAGCTTTA<br>CATCAGGAGATAAAGTGCACATGGATACATAGCAGCCCATCCTTCGAGTACAAAACAGCATCTGAG<br>CCTCCATTGGCCCCTCCTGTGTCTGAAGAAGAAGATGAAGAGGAAGAAGAAGAAGAAGATGAAAATGA<br>GCCACCACCAGTTATCGCACCAAGACCAGAGCATACAAAATCAATCTATACTCGTTCTGTGGTTGAAT<br>CCATTGCTTCACCAGCAGTACCAAATAAAGAGGTCACACCACCCTCTGCTGAAAATGCCAATTCCAGT<br>ACTTTGTACAGGAACACAGATCGGCAAAGAAAAAATCCAAGATGACAGATGAGGAGATCTTAGAGAA<br>GCTAAGAAGCATTGTGAGTGTTGGGGACCCAAAGAAAAAATACACAAGATTTGAAAAATTGGTCAAG<br>GGGCATCAGGTACTGTTTATACAGCACTAGACATTGCAACAGGACAAGAGGTGGCCATAAAGCAGATG<br>AACCTTCAACAGCAACCCAAGAAGGAATTAATTATTAATGAAATTCTGGTCATGAGGGAAAATAAGAA<br>CCCTAATATTGTTAATTATTTAGATAGCTACTTGGTGGGTGATGAACTATGGGTAGTCATGGAATACT<br>TGGCTGGTGGCTCTCTGACTGATGTGGTCACAGAGACCTGTATGGATGAAGGACAGATAGCAGCTGTC<br>TGCAGAGAGTGCCTGCAAGCTTTGGATTTCCTGCACTCAAACCAGGTGATCCATAGAGATATAAAGAG<br>TGACAATATTCTTCTCGGGATGGATGGCTCTGTTAAATTGACTGACTTTGGGTTCTGTGCCCAGATCA<br>CTCCTGAGCAAAGTAAACGAAGCACTATGGTGGGAACCCCATATTGGATGGCACCTGAGGTGGTGACT<br>CGAAAAGCTTATGGTCCGAAAGTTGATATCTGGTCTCTTGGAATTATGGCAATTGAAATGGTGGAAGG<br>TGAACCCCCTTACCTTAATGAAAATCCACTCAGGGCATTGTATCTGATAGCCACTAATGAACTCCAG<br>AGCTCCAGAATCCTGAGAGACTGTCAGCTGTATTCCGTGACTTTTTAAATCGCTGTCTTGAGATGGAT<br>GTGGATAGGCGAGGATCTGCCAAGGAGCTTTTGCAGCATCCATTTTTAAAATTAGCCAAGCCTCTCTC<br>CAGCCTGACTCCTCTGATTATCGCTGCAAAGGAAGCAATTAAGAACAGCAGCCGCTAAGACTGCAAGC<br>CTTACACCTCCACCATCTCCCTCATGAGTAAGACTGAAATAAAACTCTGCTGCAGGAAAGATGGAAGAA<br>AAGACAGTCAAATGGGGTGGGGGTTCTTTACCTTTCAAATGAATAGAAACTTCTTATAAGCCTTTTTC<br>CTACTCCCTCAGATTATGTAATTTATTTGTAAGCCTGAATCGCAGCCCAAACAGGGCAGCAATGTTGA<br>AGTGACCATAAAGTGGTCACTTCCACCGTGAAGCGAAAGAGCCAGTAGTGAATCCCCTCATTTGTGC<br>ATTCACTTTGAAGAAAAAGGTTTCTCAAAGATGCACACTCCCTCTTCATAGTGTTGTGTTTGTTTTTA<br>AGTTAGAGAGTAGTCCCTCTTGCATTCAAACCTCCTTCAAAACTCCTTACCCAATGTGATGTTTTTCA<br>CTTGCATTGTCATTAGATGTCCAGAAAAAAAAAGATGTCAAATGTTTTTCTAAAAAAAGAAAGCAA<br>AAAAAGCAAGGCAAAAAAAAAAAAAAAACAAACAAAAACAAAAACAAAACAAAAACAAGCAAACAAA<br>AAATACCAGAGCAAGTACTGTGTGAACATGTGGAAGTCCATGCCCTAATAGAGTTGCAATTTTTTATT<br>CTTCTTCTATAGTGGTGGCTTGGTTTGTGTACCTATTTTTCTGCATTTGTATTGGAAAAGGTTTCTTT<br>TAAGACATTTTCCAAAAGTGGAGAGGAATATGTGTGTTCAGGAAGGGCTTTCAAAAAACTGTATATCT<br>AAATAAAGCTCAAACGGTGAAATCCTGTCACATTTTCACAATGATGCTTAAAAGATAATTGAGTAAAC<br>CAGGTTGTTAATCTCCTTAATACCTGAAAGAGGACACACTGAAACTGAAACTGTGACATCCTGCTAGG<br>TGAGTTCAGGTTCTGAACCTAGGAAATCCTCATAGGAGAAACCACATTTAAACAAAGATGGGACTTTC<br>TCTGAGAGCCAAAACCAGATAAATGTAGAATACTGAAATCCTTGTTGGACATTAAGTAAACAAAGATA<br>ATGATACCTAAATTAATCCTCTCTTGTGCTTATGAAACATATGCACTGTAAATAGGCATACCAGGAG<br>GAAATAGATACATTAATCATCATTTACTTATGATACAAATTATTTATTTTGACAATTTATAACGTTTA<br>AAAAAGTTTTTTAAAGATCTAGAGAAAGTGATATAGTAAACATTCAACTCTGTAAGAAATGGGAGGT<br>CAGTGAAGGCTACATCCCAATCAATATTTGGCTCTAAGTACCTCTTCCCATTTTTCCTATGTATCACC<br>TATTTCTGTTTCGGAATATGGTGTGTTCATGCTTAGTTCTTTGGGCTTTTGAATATCAAAAGCATATT<br>CATAAATGTCTTGAAATTCTCTCCAGTGGAAAATAATTTTAACTTACAATCATATCCCAAGAAATGTC<br>AGTCCGACAGAATTCCTTATATGACTTGGGGAAAATAACAAAATTTGACTACTATTTCACCATATATC<br>TATTTATTAAAAAATTCAACAGTTGGCACTTCCTGAATCTTCTGAGAGTAGAAAAATATCTGCGGAGT<br>GTCTGTGTAGAAAAGGATATGCCTCTCTTTTGAGTGTATTGACAATTTTGTAAATTACAGAAAGTTGT<br>TTCTCTAAGCCTTTGAAAAACTAAACAATTTGTGTTATAGAAGGCTTCTTAATTTGCAGTATAAAAGAA<br>TCTAAACAGAACTTATGTACATTCAGCCAGAAGGGGAAAGAGATCAGTTACATAGGCCTCTCTCCTTC<br>TTTGCCAAGGTACATCCATCCATCTAACCATCCATATATCCACATCTTAAAATGAAAGCACTTTCTTT<br>AGAGTTTCAGCAAACTATATAGTGTACGTGTTTATGTTCAGGAGATGACCCCACTGGTGTATTTCCTA<br>TTTTCCCTATTGTTTCTTTGACTGTAAAAGTTGGGAGAGGCTTGACCTCCTCCCCTTGAAAATGTCC<br>ACAGTGGGATAAAACAACAAATGTGAAAAGAAAATGAAACGGTAATATTAATTTGAAGCATACTATGT<br>TATACTTTGCAAAAACGAATCTGGGCCTGTAATTTTTAATGCCACACTGCTCTAATGAGAGAGAGAGG<br>CCTTAATTTTGATTTCATTTAAAAATAAGTACTTTAAAAAATTTTTCACTCATAGTGCCGGGAAATTC<br>AATGAAATCCTGGGATGCAAATAAAAATCAGTACATTAGTGACTGTGTCCTGCCAGTGGAGAGAGCCC<br>AATACCTGGTTAGGAAGCCCTATTCATTAGTTAGCATCCCTTACATGTTGAGAAGGCCTTTTTTTGT<br>TGTTATTTTGGAGACCTTGGAGCAGTGACCCTTCAGATCACTGTAGGCAGAGAAATGGCTTCTCTCTT<br>ATGCTTTCAGTTCAGCATATTAACAATGAGGAGCCAGGTACTTCTTTACTACCACTTTGTACCAAGAT<br>TTGATAATAATATATCCCAGGAGGCATTACTTTTATAAATTTGTATTCATGTAAATTTTCAAATGAGA<br>ACAGCTTCTAAAGCCCCTTCCCTGTATTGGAGAGTTATGTATATTTCTAATAAGTATTAGAAAGAAGC<br>TGTTTCTCATGCCACAGTGATGCTGAAGGATTCACATTTGGTACAATCGAGTAACTTGAACGCCAGAT<br>TGTTAACAGTTTATTCTCTTTCCCTGGATTTTTAAGCTCATCTTGACACAGGTGAGTCTATCCAAATC<br>TTTGATGTTGCTAGTGTGCCCTGAGATAACGAGGGCACATCTTTCAATGTTGATTCCAAAATGTCCTG<br>AGTTAGGAATAGGGCAGTGGGAAAGTCAGGGAAGGGTGAGAAGCACAGTAGAGATTATTTATTTAAAA<br>AAGGAAAGAACGTTAATGTTGTTACAAGGATCCAGTGCGTTGTCATAATCCCATGAAGATTTTCAGA<br>TGACACAATCCCCTCAAATCAGTCACCATGTTGGGTAATGACTTCGTTCTTGCTGATCTCGTGTGTGT<br>GTCATTGTAAATATTTGTGTGTCCATGTTCCATTTTGGCTACTGGATGGCCAAGCCATGTAAGAAGAT<br>TTAACTCAAGTATTTATTCTTTATGTTATTCAGATTTCTTTCAGGCTTGTGAACTGCACCCCAATGTT<br>TGAGTTTAACCACCTGATCCTTACATCTATCCCTCCCCGGTGAAGCACATTCCATTGCTAAAAGAAAA<br>AGAAACACGAAATTGCTTCCTGTTGTCTGTATAACTGTTTTGATAGTTTGAGATATTTGTCTATAAAT |

TABLE 14-continued

Target sequences.

| SEQ ID NO: | Description | Sequence |
|---|---|---|
| | | GATATTTCTCAGCTCAAAGATCGTGTAAATAATTATATTCCTTTGCTCAATGGGTTTATTTCTAATGA<br>GGCTGCCAGTTCTGAGAGATTCTATAATATCACTTTTAAATAACATAAACAGGGATTACAACTATGTA<br>AAAAGAAATGCATATGGACAAAGACTGGGAACACAGATAATTGAAATCAGTTGTGTTAGGGTGGTGGA<br>ATTATGTGAATTTTTTTTCTTTTTAAAATTTTATTTGATATTGTTATAATATTGCTTTACAATAAAT<br>AAACAGCAGAAAGGGAACTATAGACACATAGAAAAGATGCCAGAAGCAGATGCCTTCTGGCCAGAGCG<br>CAGAGCATGCAGGGCAGAGATATTTGCTAGTTACAATTATTCCATAGGCTTTATGCTTGCCTGGGTGC<br>TGAGGTTGGCACACGCTCGGGTATGGCACACGCTTTCTTAGGGACTATTATCTATAAGTTAAAGCTA<br>GGGAGATGTCACTATTAGAACTCCAAACACACTCTTCTGCTTTAAAACAGGTTGTCTGCCCTCTGCTT<br>TGGTATGGCATTCGGGTGTCTGTTTTGTGGTTGCTTTAGATTGGAGGGGTGACCATTTTATTAGCCCC<br>CTTGATAACATCTGTTGCAGATATTGCCTTTCTGGAACGTTTTAACAGACTCTCAGGTTGAATTTTGG<br>AGGACTAGAAGGATAAAATCCCCAGCTCCCACCATTTTCTTGTCCAACAGGATATTACTGTATATCAT<br>TCAGGTAGGATTCTTCTTTTAATAACCAATAGGGCAAGTCCCACTAATTTCAATAGAAGTTATGACTT<br>GCAATTAAAAGCTGACTTTGAAATCATTAAACAAATATGTAGGACTGTCTCTGCCTGTTGGCATTCAG<br>TTATAGTTCTGTTAATTTTGGCTTGGGATGGTCTCCATGTGCTTTTTCTGCCTATTTATAGGTTGTT<br>TGCAGTAGTTGTGATTTTAAAGAGCAAGGGAGACCATCTAACCAAAGGATAACTTCCTTCTAACTCA<br>CCAAAGAAATTTTAGGTGAGAACTTTAATAATGAGGTAGTCACCTCAGATATGCTGCTTAGTTTCACT<br>AAAAGCAGACCCTATACCTAGAGAAGTCACTGGCTTTTTATTGGTCATTCTCAATACAGAAATACTTA<br>GGGGAGTCTTAACCCTGCCATCCCCGGTTGAATCTCTTGGTCTTTATCTAAGCTACTTGCAGTTAATA<br>TTCAGTTAAGCAAAGGTATGGCCAGTAGTGCAAGTATCTCCCAGTCTCTGAGCTCTGAACAAGAGGAC<br>TGAAATTCAGCATTTGTAAACTGACAGTTTGATGGGCCTGGGATTTGAAGTGAACTCAGCACACAATT<br>CTGAACGTGTATTTGCATGTGGACTGGGAAGGAAATAAATGGGAACTTGGAAATAATGGAATATTTCT<br>CCTATGAAAGAATTTTTCGTAGAAGATTTGTTTTTGATATAATCTTTCTGTTGGTTAGCTTTTAGTGT<br>TTTCATTCCTTTTCTGATCCACACTCCTTTAAGTGACCAAATGAATATAACCCAACATGCATTGGGAA<br>TGTGTTTAATATTAAACAATGTCTAACTGAATCTGCAAATGCGGGAACTGAGATATCACCTCCATGTG<br>CACACCTGTGTGTACAGTATTCTATACAACTTGTAGCATTTACTGCCACTTAATTGGGTTGAACTTG<br>CAAGATAAACTTTTGGAAACTGCTTAGTGCCATCGGAGTCTCCTTTAGAAGCTGCCATCAGGCAAATG<br>CTATCCCATAATACCAGCAGTAAGCCTGGCAACATGTTCAACAGATTTAGTACCCAAGAGGAAATCAA<br>CAGCGATAGTAGAGAATGAGTCAGATGTAGTGGGATAAATACTAGCCTAGGAAGAAGGAGCCCCGGAG<br>TCTAATATGAGCTTTATTACTAAATTGCTATGTGACGCTAGGCAAGTCACTTAACCTCTCCATGCTG<br>TTTCCTCATCTGTAAAATAAGTGTATTGGACTAGATGATCCTTAGGGTCTTTCCAAAAGTCTAACATT<br>CTATGGCATTATAGGTTGCCTTGCAAATTCAGCCTGCTATAGTGATGGCAAATATCACGTTTAAGCCT<br>GAGTCTCTTATGTTGCAGTTAAATAAAAGAACTATGTAAGATGATTTTTAAAATTCAAGCAAATGGGC<br>CGGGTGCGGTGGCTCATACCTGTAATCCCAGCACTTTGGGAGGCCAAGGCAGGCGGATCACCTGAGGT<br>CAGGAGTTCGAGACCAGCCTGACCAACATAGAGAAACCCCATCTCTACTAAAAATACAAAATTAGCCG<br>GGTGTGGTGGCGGGCGCCTGTAATCCCAGCTACTTGGGAGGCTGAGGTGGGAGAATCGCTTGAACCCA<br>GGAGGCGGAGGTTGTGGTGAGCTGAGATCATGCCATTGCACTCCAGCCTCGGCAACAAGAGTGAAACT<br>TCGTCTCCAAAAAAAAAAACTCAAGCAAATGAAGTTCATAATAATAGGGATGTTGATAAAACTTGTG<br>GCAGCCTTCCAATTCATTTACAGTTGTTTCGTTTTGTTTTTGTTTTAATGTCCATTTTCTGTTGACTG<br>TTCCCAGTTTTCATTTTCCATACAGTCTGTATGTAAAGTCTGGTTTTCATTAAGCTGTGGCCAGTATT<br>TGCCACTACAACAGAAACACACTGTCACACTTGCTAGAATATAACTGTACTTGAGCTTCTCCTTTCCT<br>GTGAAGTAGTGCTGGGCTTTCTAGAGTTTAATTCTCAAGTGGCACAAGATAGCAGAGCCCATGCATTT<br>TAATGGCTGAGACTGCTAAGAGTGAACCTAAACACTTACAAGTTGCAGAGAGAAATGAAAAGTAATT<br>ACATGCTATTAGCATTGAGAAATGTTGACAAATTAATTTGTTGGGAACCAAAGATAGCATTTCTGATG<br>ACAACTCCCACAGTGATTGGCCAGTTGTATGATGAGTACACTGCTGGAAAGAGGGTAAACTGGGAGTT<br>AGTGGATGGTCCCAATGCCCTGCCTACAGCAGAGTGCCAACCAGCCCTGAGTGCAAAATTCAAGTTCA<br>ATGTGTGTGCTTGTGTGGTGTGCTTTATGGACCCGCAAATACCATATTCATTATTGATGATAAGAT<br>CTTCACAGAATCCTGTAGCTACTAATGCATTGAGTTTTTAATCTCAGTACATCAGCCAGGAGGAGCCA<br>GATCACAGGGTAGTGATGTCTACTGGGATTATACTCATAACATCTACACAAAACAAGTTGAGAAGGAT<br>CCACGTTTTCATTGTTTATCAGAATTGTATCTCATTTGGCTGAGCATTACTTTTGTCAGAATGTGTTA<br>TCTGTAAACCATGTGTAGTGAAATTCTTCTGTAACTTTGGATTAAAGGTATTTATGATTCATTTTGTT<br>GTTTGATTTTAAGTAAGTTATTTCTTTTGTAGACCTGCTGATGGTATGGTTCCATCCTTCTGACCTC<br>AGCATCCAATCTTTTTAAGGATTTTTGTTTTCAATATTGTTATTTTAAATTGTGGTTGAAGCAATAGA<br>AAATTGAAATATGGATTGTGCATGACTGTGTCTTGAGTGTAAAAATATTGCAGTTTGAAACTTGGACC<br>TAAAGTATTGCAAATAAAAATGACAAACATCAATGA |
| 7190 | Human PAK3<br>transcript variant<br>4 mRNA<br>NM_001128168.3<br>(GI: 1676441496<br>version 3) | ACCGCGGGCGGGCAGCTGTGCCAGCTAACCGTCTGGGATCTCGCACTGGGGGCTGCAGCTTTTCCCCG<br>CCTCGAGCCAGTGTGCGGGGCGGGAGAAGAGCCAGGGGGAGCGGGCTGGGCCCGGGGCTGCGGCTGC<br>GGCCGCGGGGCTGCGGCTCCCCAGCCCCGCCAGCTGGAGCGCTCGGAGGTAGAGGAAAGGTCTTGACG<br>GGGTGGCTGGATCCGTGGCAGAATCCAGTTCCAGATTCTAGACTTGAGGGTTCTGGGCTGTTGGTCTG<br>TAGAGTCGAAGGAGAGAAGGACTCAAATCCAGGCCAAGTGTATGGCTGTCTGAGGTATTGGAACAGAA<br>GGAGGTCCATTCCTGTTGGTGACAACACCGTGGCCCTGTTCTGGGATGAGCAAGGTGTAAAGCAGGTT<br>TCCCCCAAGAAAGAGCAGCTGAGTCCTTGCATCTTGTGGCAGCTGGTGTGCCCAGCACTGAGTCTGTA<br>GGAGCTGAAGCCAGCCCGGACCCTTCTCATGGGCAGTGCCCACCTGTGCTGAAGTCCTGCAGCGGTGG<br>CGGTGTGAGGAGCTGTGAAATTAGTTGTAACTGAAAATGTCTGACGGTCTGGATAATGAAGAGAAACC<br>CCCGGCTCCTCCACTGAGGATGAATAGTAACAACCGGGATTCTTCAGCACTCAACCACAGCTCCAAAC<br>CACTTCCCATGGCCCCTGAAGAGAAGAATAAGAAAGCCAGGCTTCGCTCTATCTTCCCAGGAGGAGGG<br>GATAAAACCAATAAGAAGAAGGAAGAAAAGAGCGCCCAGAGATCTCTCTTCCTTCAGACTTTGAGCATAC<br>GATTCATGTGGGGTTTGATGCAGTCACCGGGGAATTCACTAACTCCCCTTTCCAGACCTCTAGACCTG<br>TGACGGTCGCTTCAAGTCAATCAGAGGGAAAAATGCCAGATCTCTATGGCTCACAGATGTGCCCAGGG<br>AAGCTCCCAGAGGGAATTCCAGAGCAATGGGCACGATTACTCCAAACTTCCAACATAACAAAATTGGA<br>ACAGAAGAAGAACCCACAAGCTGTTCTAGATGTTCTCAAATTCTACAGCTTCTTTCTATGATTCCAAAACAGTCAACA<br>ACCAGAAATACATGAGCTTTACATCAGGAGATAAAAGTGCACATGGATACATAGCAGCCCATCCTTCG<br>AGTACAAAAACAGCATCTGAGCCTCCATTGGCCCCTCCTGTGTCTGAAGAAGAAGATGAAGAGGAAGA<br>AGAAGAAGAAGATGAAAATGAGCCACCACCAGTTATCGCACCAAGACCAGAGCATACAAAATCAATCT<br>ATACTCGTTCTGTGGTTGAATCCATTGCTTCACCAGCAGTACCAAATAAAGAGGTCACACCACCCTCT<br>GCTGAAAATGCCAATTCCAGTACTTTGTACAGGAACACAGATCGGCAAAGAAAAAAATCCAAGATGAC |

TABLE 14-continued

Target sequences.

| SEQ ID NO: | Description | Sequence |
|---|---|---|
| | | AGATGAGGAGATCTTAGAGAAGCTAAGAAGCATTGTGAGTGTTGGGGACCCAAAGAAAAAATACACAA |
| | | GATTTGAAAAAATTGGTCAAGGGGCATCAGGTACTGTTTATACAGCACTAGACATTGCAACAGGACAA |
| | | GAGGTGGCCATAAAGCAGATGAACCTTCAACAGCAACCCAAGAAGGAATTAATTATTAATGAAATTCT |
| | | GGTCATGAGGGAAAATAAGAACCCTAATATTGTTAATTATTTAGATAGCTACTTGGTGGGTGATGAAC |
| | | TATGGGTAGTCATGGAATACTTGGCTGGTGGCTCTCTGACTGATGTGGTCACAGAGACCTGTATGGAT |
| | | GAAGGACAGATAGCAGCTGTCTGCAGAGAGTGCCTGCAAGCTTTGGATTTCCTGCACTCAAACCAGGT |
| | | GATCCATAGAGATATAAAGAGTGACAATATTCTTCTCGGGATGGATGGCTCTGTTAAATTGACTGACT |
| | | TTGGGTTCTGTGCCCAGATCACTCCTGAGCAAAGTAAACGAAGCACTATGGTGGGAACCCACATATTGG |
| | | ATGGCACCTGAGGTGGTGACTCGAAAAGCTTATGGTCCGAAAGTTGATATCTGGTCTCTTGGAATTAT |
| | | GGCAATTGAAATGGTGGAAGGTGAACCCCCTTACCTTAATGAAAATCCACTCAGGGCATTGTATCTGA |
| | | TAGCCACTAATGGAACTCCAGAGCTCCAGAATCCTGAGAGACTGTCAGCTGTATTCCGTGACTTTTTA |
| | | AATCGCTGTCTTGAGATGGATGTGGATAGGCGAGGATCTGCCAAGGAGCTTTTGCAGCATCCATTTTT |
| | | AAAATTAGCCAAGCCTCTCTCCAGCCTGACTCCTCTGATTATCGCTGCAAGGAAGCAATTAAGAACA |
| | | GCAGCCGCTAAGACTGCAAGCCTTACACCTCACCATCTCCCTCATGAGTAAGACTGAAATAAAACTCT |
| | | GCTGCAGGAAAGATGGAAGAAAAGACAGTCAAATGGGGTGGGGGTTCTTTACCTTTCAAATGAATAGA |
| | | AACTTCTTATAAGCCTTTTTCCTACTCCCTCAGATTATGTAATTTATTTGTAAGCCTGAATCGCAGCC |
| | | CAAACAGGGCAGCAATGTTGAAGTGACCATAAAGTGGTCACTTCCACCGTGAAGCGAAAGAGCCAGTA |
| | | GTGAATCCCCTCATTTTGTGCATTCACTTTGAAGAAAAAGGTTTCTCAAAGATGCACACTCCCTCTTC |
| | | ATAGTGTTGTGTTTGTTTTTAAGTTAGAGAGTAGTCCCTCTTGCATTCAAACCTCCTTCAAAACTCCT |
| | | TACCCAATGTGATGTTTTTCACTTGCATTGTCATTAGATGTCCAGAAAAAAAAAAGATGTCAAAATGT |
| | | TTTTCTAAAAAAAGAAAGCAAAAAAAGCAAGGCAAAAAAAAAAAAAAAAACAAACAAAAACAAAAACA |
| | | AAACAAAAACAAGCAAACAAAAAAATACCAGAGCAAGTACTGTGTGAACATGTGGAAGTCCATGCCCTA |
| | | ATAGAGTTGCAATTTTTTATTCTTCTTCTATAGTGGTGGCTTGGTTTGTGTACCTATTTTTCTGCATT |
| | | TGTATTGGAAAAGGTTTCTTTTAAGACATTTTCCAAAGTGGAGAGGAATATGTGTGTTCAGGAAGGG |
| | | CTTTCAAAAAACTGTATATCTAAATAAAGCTCAAACGGTGAAATCCTGTCACATTTTCACAATGATGC |
| | | TTAAAAGATAATTGAGTAAACCAGGTTGTTAATCTCCTTAATACCTGAAAGAGGACACACTGAAACTG |
| | | AAACTGTGACATCCTGCTAGGTGAGTTCAGGTTCTGAACCTAGGAAATCCTCATAGGAGAAACCACAT |
| | | TTAAACAAAGATGGGACTTTCTCTGAGAGCCAAAACCAGATAAATGTAGAATACTGAAATCCTTGTTG |
| | | GACATTAAGTAAACAAAGATAATGATACCTAAATTAATCCTCTCTTGTGCTTATGAAACATATGCACT |
| | | GTAAAATAGGCATACCAGGAGGAAATAGATACATTAATCATCATTTACTTATGATACAAATTATTTAT |
| | | TTTGACAATTTATAACGTTTAAAAAAGTTTTTTAAAGATCTAGAGAAAGGTGATATAGTAAACATTCA |
| | | ACTCTGTAAGAAATGGGAGGTCAGTGAAGGCTACATCCCAATCAATATTTGGCTCTAAGTACCTCTTC |
| | | CCATTTTTCCTATGTATCACCTATTTCTGTTTCGGAATATGGTGTGTTCATGCTTAGTTCTTTGGGCT |
| | | TTTGAATATCAAAAGCATATTCATAAATGTCTTGAAATTCTCTCCAGTGGAAAATAAATTTTAACTTAC |
| | | AATCATATCCCAAGAAATGTCAGTCCGACAGAATTCCTTATATGACTTGGGGAAAATAACAAAATTTG |
| | | ACTACTATTTCACCATATATCTATTTATTAAAAAATTCAACAGTTGGCACTTCCTGAATCTTCTGAGA |
| | | GTAGAAAAATATCTGCGGAGTGTCTGTGTAGAAAAGGATATGCCTCTCTTTTGAGTGTATTGACAATT |
| | | TTGTAAATTACAGAAAGTTGTTTCTCTAAGCCTTTGAAAAACTAACAATTTGTGTTATAGAAGGCTTC |
| | | TTAATTTGCAGTATAAAAGAATCTAAACAGAACTTATGTACATTCAGCCAGAAGGGGAAAGAGATCAG |
| | | TTACATAGGCCTCTCTCCTTCTTTGCCAAGGTACATCCATCCATCTAACCATCCATATATCCACATCT |
| | | TAAAATGAAAGCACTTTCTTTAGAGTTTCAGCAAACTATATAGTGTACGTGTTTATGTTCAGGAGATG |
| | | ACCCCACTGGTGTATTTCCTATTTTCCCTATTGTTTTCTTTGACTGTAAAAGTTGGGAGAGGCTTGAC |
| | | CTCCTCCCCTTGAAAATGTCCACAGTGGGATAAAACAACAAATGTGAAAAGAAAATGAAACGGTAATA |
| | | TTAATTTGAAGCATACTATGTTATACTTTGCAAAAACGAATCTGGGCCTGTAATTTTTAATGCCACAC |
| | | TGCTCTAATGAGAGAGAGAGGCCTTAATTTTGATTTCATTTAAAAATAAGTACTTTAAAAAATTTTTC |
| | | ACTCATAGTGCCGGGAAATTCAATGAAATCCTGGGATGCAAATAAAAATCAGTACATTAGTGACTGTG |
| | | TCCTGCCAGTGGAGAGAGCCCAATACCTGGTTAGGAAGCCCTATTCATTAGTTAGCATCCCTTACATG |
| | | TTGAGAAGGCCTTTTTTTTGTTGTTATTTTGGAGACCTTGGAGCAGTGACCCTTCAGATCACTGTAGG |
| | | CAGAGAAATGGCTTCTCTCTTATGCTTTCAGTTCAGCATATTAACAATGAGGAGCCAGGTACTTCTTT |
| | | ACTACCACTTTGTACCAAGATTTGATAATAATATATCCCAGGAGGCATTACTTTTTAAAATTTGTATT |
| | | CATGTAAATTTTCAAATGAGAACAGCTTCTAAAGCCCCTTCCCTGTATTGGAGAGTTATGTATATTTC |
| | | TAATAAGTATTAGAAAGAAGCTGTTTCTCATGCCACAGTGATGCTGAAGGATTCACATTTGGTACAAT |
| | | CGAGTAACTTGAACGCCAGATTGTTAACAGTTTATTCTCTTTCCCTGGATTTTTAAGCTCATCTTGAC |
| | | ACAGGTGAGTCTATCCAAATCTTTGATGTTGCTAGTGTGCCCTGAGATAACGAGGGCACATCTTTCAA |
| | | TGTTGATTCCAAAATGTCCTGAGTTAGGAATAGGGCAGTGGGAAAGTCAGGGAAGGGTGAGAAGCACA |
| | | GTAGAGATTATTTATTTAAAAAAGGAAAGAACGTTAATGTTGTTAGCAAGGATCCAGTGCGTTGTCAT |
| | | AATCCCATGAGGATTTTCAGATGACACAATCCCCTCAAATCAGTCACCATGTTGGGTAATGACTTCGT |
| | | TCTTGCTGATCTCGTGTGTGTGTCATTGTAAATATTTGTGTGTCCATGTTCCATTTTGGCTACTGGAT |
| | | GGCCAAGCCATGTAAGAAGATTTAACTCAAGTATTTATTCTTTATGTTATTCAGATTTCTTTCAGGCT |
| | | TGTGAACTGCACCCCAATGTTTGAGTTTAACCACCTGATCCTTACATCTATCCCTCCCCGGTGAAGCA |
| | | CATTCCATTGCTAAAAGAAAAAGAAACACGAATTGCTTCCTGTTGTCTGTATAACTGTTTTGATAGT |
| | | TTGAGATATTTGTCTATAAATGATATTTCTCAGCTCAAAGATCGTGTAAATAATTATATTCCTTTGCT |
| | | CAATGGGTTTATTTCTAATGAGGCTGCCAGTTCTGAGAGATTCTATAATATCACTTTTAAATAACATA |
| | | AACAGGGATTACAACTATGTAAAAGAAATGCATATGGACAAAGACTGGGAACACAGATAATTGAAAT |
| | | CAGTTGTGTTAGGGTGGTGGAATTATGTGAATTTTTTTTCTTTTTAAAATTTATTTGATATTGTTA |
| | | TAATATTGCTTTACAATAAATAAACAGCAGAAAGGGAACTATAGACACATAGAAAAGATGCCAGAAGC |
| | | AGATGCCTTCTGGCCAGAGCGCAGAGCATGCAGGGCAGAGATATTTGCTAGTTACAATTATTCCATAG |
| | | GCTTTATGCTTGCCTGGGTGCTGAGGTTGGCACACGCTCGGGTATGGCACACGCTTTCTTAGGAGACT |
| | | ATTATCTATAAGTTAAAGCTAGGGAGATGTCACTATTAGAACTCCAAACACACTCTTCTGCTTTAAAA |
| | | CAGGTTGTCTGCCCTCTGCTTTGGTATGGCATTCGGGTGTCTGTTTTGTGGTTGCTTTAGATTGGAGG |
| | | GGTGACATTTTATTAGCCCCTTGATAACATCTGTTGCAGATATTGCCTTTCTGGAACGTTTTAACA |
| | | GACTCTCAGGTTGAATTTTGGAGGACTAGAAGGATAAAATCCCCAGCTCCCACCATTTTCTTGTCCAA |
| | | CAGGATATTACTGTATATCATTCAGGTAGGATTCTTCTTTTAATAACCAATAGGGCAAGTCCCACTAA |
| | | TTTCAATAGAAGTTATGACTTGCAATTAAAAGCTGACTTTGAAATCATTAAACAAATATGTAGGACTG |
| | | TCTCTGCCTGTTGGCATTCAGTTATAGTTCTGTTAATTTTGGCTTGGGATGGTCTCCATGTGCTTTTT |
| | | TCTGCCTATTTATAGGTTGTTTGCAGTAGTTGTGATTTTTAAAGAGCAAGGGAGACCATCTAACCAAA |

TABLE 14-continued

Target sequences.

| SEQ ID NO: | Description | Sequence |
|---|---|---|
| | | GGATAACTTCCTTCTAACTCACCAAAGAAATTTTAGGTGAGAACTTTAATAATGAGGTAGTCACCTCA
GATATGCTGCTTAGTTTCACTAAAAGCAGACCCTATACCTAGAGAAGTCACTGGCTTTTTATTGGTCA
TTCTCAATACAGAAATACTTAGGGGAGTCTTAACCCTGCCATCCCCGGTTGAATCTCTTGGTCTTTAT
CTAAGCTACTTGCAGTTAATATTCAGTTAAGCAAAGGTATGGCCAGTAGTGCAAGTATCTCCCAGTCT
CTGAGCTCTGAACAAGAGGACTGAAATTCAGCATTTGTAAACTGACAGTTTGATGGGCCTGGGATTTG
AAGTGAACTCAGCACACAATTCTGAACGTGTATTTGCATGTGGACTGGGAAGGAAATAAATGGGAACT
TGGAAATAATGGAATATTTCTCCTATGAAAGAATTTTTCGTAGAAGATTTGTTTTTGATATAATCTTT
CTGTTGGTTAGCTTTTAGTGTTTTCATTCCTTTTCTGATCCACACTCCTTTAAGTGACCAAATGAATA
TAACCCAACATGCATTGGGAATGTGTTTAATATTAAACAATGTCTAACTGAATCTGCAAATGCGGGAA
CTGAGATATCACCTCCATGTGCACACCTGTGTGTACGAGTATTCTATACAACTTGTAGCATTTACTGC
CACTTAATTGGGTTGAACTTGCAAGATAAACTTTTGGAAACTGCTTAGTGCCATCGGAGTCTCCTTTA
GAAGCTGCCATCAGGCAAATGCTATCCCATAATACCAGCAGTAAGCCTGGCAACATGTTCAACAGATT
TAGTACCCAAGAGGAAATCAACAGCGATAGTAGAGAATGAGTCAGATGTAGTGGGATAAATACTAGCC
TAGGAAGAAGGAGCCCCGGAGTCTAATATGAGCTTTATTACTAAATTGCTATGTGACGCTAGGCAAGT
CACTTAACCTCTCCATGGCTGTTTCCTCATCTGTAAAATAAGTGTATTGGACTAGATGATCCTTAGGG
TCTTTCCAAAAGTCTAACATTCTATGGCATTATAGGTTGCCTTGCAAATTCAGCCTGCTATAGTGATG
GCAAATATCACGTTTAAGCCTGAGTCTCTTATGTTGCAGTTAAATAAAAGAACTATGTAAGATGATTT
TTAAAATTCAAGCAAATGGGCCGGGTGCGGTGGCTCATACCTGTAATCCCAGCACTTTGGGAGGCCAA
GGCAGGCGGATCACCTGAGGTCAGGAGTTCGAGACCAGCCTGACCAACATAGAGAAACCCCATCTCTA
CTAAAAATACAAAATTAGCCGGGTGTGGTGGCGGGCGCCTGTAATCCCAGCTACTTGGGAGGCTGAGG
TGGGAGAATCGCTTGAACCCAGGAGGCGGAGGTTGTGGTGAGCTGAGATCATGCCATTGCACTCCAGC
CTCGGCAACAAGAGTGAAACTTCGTCTCCAAAAAAAAAAACTCAAGCAAATGAAGTTCATAATAATAG
GGGATGTTGATAAAACTTGTGGCAGCCTTCCAATTCATTTACAGTTGTTTCGTTTTGTTTTTGTTTTA
ATGTCCATTTTCTGTTGACTGTTCCCAGTTTTCATTTTCCATACAGTCTGTATGTAAAGTCTGGTTTT
CATTAAGCTGTGGCCAGTATTTGCCACTACAACAGAAACACACTGTCACACTTGCTAGAATATAACTG
TACTTGAGCTTCTCCTTTCCTGTGAAGTAGTGCTGGGCTTTCTAGAGTTTAATTCTCAAGTGGCACAA
GATAGCAGAGCCCATGCATTTTAATGGCTGAGACTGCTAAGAGTGAACCTAAACACTTACAAGTTGCA
GAGAGAAATGAAAAGTAATTACATGCTATTAGCATTGAGAAATGTTGACAAATTAATTTGTTGGGAA
CCAAAGATAGACATTTCTGATGACAACTCCCACAGTGATTGGCCAGTTGTATGATGAGTACACTGCTGG
AAAGAGGGTAAACTGGGAGTTAGTGGATGGTCCCAATGCCCTGCCTACAGCAGAGTGCCAACCAGCCC
TGAGTGCAAAATTCAAGTTCAATGTGTGTGCTTGTGTGGTGTGCTTTATGGACCCGCAAATACCAT
ATTCATTATTGATGATAAGATCTTCACAGAATCCTGTAGCTACTAATGCATTGAGTTTTTAATCTCAG
TACATCAGCCAGGAGGAGCCAGATCACAGGGTAGTGATGTCTACTGGGATTATACTCATAACATCTAC
ACAAAACAAGTTGAGAAGGATCCACGTTTTCATTGTTTATCAGAATTGTATCTCATTTGGCTGAGCAT
TACTTTTGTCAGAATGTGTTATCTGTAAACCATGTGTAGTGAAATTCTTCTGTAACTTTGGATTAAAG
GTATTTATGGTCTTTTTGTTTGTTTGATTTTTAAGTAAGTTATTCTTTTGTAGACCTGCTGATGGTA
TGGTTCCATCCTTCTGACCTCAGCATCCAATCTTTTTAAGGATTTTTGTTTTCAATATTGTTATTTTA
AATTGTGGTTGAAGCAATAGAAAATTGAAATATGGATTGTGCATGACTGTGTCTTGAGTGTAAAAATA
TTGCAGTTTGAAACTTGGACCTAAAGTATTGCAAATAAAAATGACAAACATCAATGA |
| 7191 | Human TRNP1 mRNA NM_001013642.3 (GI: 1519242294 version 3) | GGGGTGGGGGCTGTGGCCGTGTCTAGCTGTTCGGGTGTGCTGTGGTCATCCTCCCTGCGCACCTACAG
CCGCAGAACCGCCGGTGGGGGGCGGGGATGCCGGGCTGCCGCATCAGCGCCTGCGGCCCGGGGGCCCA
GGAGGGGACGGCAGAGCAGAGGTCGCCGCCGCCGCCCTGGGATCCCATGCCGTCCTCTCAGCCCCCGC
CCCCAACTCCGACCTTGACTCCTACCCCGACCCCGGGTCAGTCCCCGCCGCTGCCGGACGCAGCTGGG
GCTTCAGCAGGCGCGGCCGAGGACCAGGAGCTGCAGCGCTGGCGCCAGGGCGCTAGCGGGATCGCGGG
GCTCGCCGGCCCCGGAGGGGGCTCTGGCGCGGCTGCGGGGGCGGGGGCTCGCGCGCTGGAGCTGGCCG
AAGCACGGCGGCGGCTGCTGGAGGTGGAGGGCCGCCGGCGCCTGGTGTCGGAGCTGGAGAGCCGCGTG
CTGCAGCTGCACCGCGTTTTCTTGGCGGCCGAGCTGCGCCTGGCGCACCGCGCGGAGAGCCTGAGCCG
CCTGAGCGGCGGCGTGGCGCAGGCCGAGCTCTACCTGGCGGCTCACGGGTCGCGCCTCAAGAAGGGCC
CGCGCCGCGGCCGCCGCGCGGCGACCCCCCGCGCTGCTGGCCTCGGCGCTGGGCTGGGCGGCTGCGTG
CCCTGGGGTGCCGGGCGACTGCGGCGCGGCCACGGCCCCGAGCCCGACTCGCCCTTCCGCCGCAGCCC
GCCCCGCGGCCCCGCCTCCCCGCAGCGCTGACCTCCACGCCCGGACCCCTGGCCACCCCGACAAGCTT
CGCCGAGGTGCCGACCGACCGACTGATCGCGGACGCCGGCTGGAAGGACTACGGATCCGCAGGAAGAG
GCAGTTGGGGGCCAGGGGCCCAGTAGAGGGCTGAGCTCCTTCCAACTCCTCAGAACCTTCCACTCTA
TGGATCTGGACCTCTGGATTCGGCTTTCTCCCTGGGCACTGCCTTCAGGAAGACGTTGAGAATTGACC
TTACACAATCCCAGCGCCCTCCTCACAGGAGCCTTTCACTTTACAGTGGCAAGGGCTGGTTCTGGAG
AACTGGCTGATGCTCTGAATTTCTTCATATACCCCACATTTGACTTTGGCTTACACTGTACAATTGGA
GATGTTGCTACAGGTCCCTGGAGATGCAATCAGATTAAGCGTAGCAAGCATTGCCAATGGGAAAGTCAA
AATAATTTATTTTTTCCCTTTCCCCCTACCCCATCCCCAGCCAAGAATTTCTTTTCAAGATATCGT
CATCATTCTTAAACAACATTCTTAACCCCCAGCTGGGGTCCCCATTTTAATAGATGTCATTGCTTCAA
GTCTAACGGCGCCGGGAGGCCTGTTTGAGGGAAAACATTAGTTTGAAAAATCCCCGTTCCCTTCATCC
ACTGCCCTTGTTCTCCACGTGGGAGTGTGCTTGTGGCCCCTCAGAAAGATAGTCTGCTGGCTCCTAGG
GGTTGGGTGGGGGACACACCTTTTTCTCAGGAAGAGGTGATGGCAATGTAAAACATCTAAGCAAAGT
TTTAAATGAAAAAAGGAAACACATTTAAACATCCTGATAATGGAGGGAAGGGGGCACATTTACACA
TAGCCCAGAACTTGTAGAATTCTGCATAGTGAATGTATATTGAATTAGTCTCCTGCCTTATACATTCA
GGAGGAATAAATTTCCATAATGTAAGGCAAATGCATGGGGTTCTGAGGTTCACTTTGCAAGTGCCCTT
GCTGCCTTTCCTCTGTGTCTATTATGGCTCTTTAAGTTGACGGTTCCTGGAGCAGCTTGTATTTAGTT
TCGTTTGGCAGTCTGGCCCTGTTGACTTTGATTTGCAGACCAATTCTCCCTTGACCTGACTCACAGCC
GCCTGCTCTTACCCCCCTCCTCAGGAAGTCTTCCTCATTAAAGGATGTGATGACGGA |
| 7192 | Human APLN mRNA NM_017413.5 (GI: 1519315208 version 5) | GAGCATTCTCTCTGGCAGCCGGGTCACGGGCAGTTGCAGCCGCGGCCGAGCAGCCAGCCGCTAAGAA
AGAGCTCGCCGCTGCCGCTCCCGGAGCCGCCGAGGCCAGCTTCGCGGCGCTGCCCCGCGGCGGGAGAG
GAGGCTGCAGAAGAGCGGAGGCGGCCAGCGGGAGCGGCGGGGCTCAGCGCGCACACTCAGCGGCCGGG
GAGCCTCCCGAGCTCTGCGCCCGCACGCGCCAGCCGCGGCTCGCGCCTTTCTTGGCCTCCGGGCGCCC
GACCTCTCCTCCCCGCGCCGGCTCGCCGGGGCCGCGGCGGCCCAAGGAGCAGCATGAATCTGCGGCT
CTGCGTGCAGGCGCTCCTGCTGCTCTGGCTCTCCTTGACCGCGGTGTGTGGAGGGTCCCTGATGCCGC |

TABLE 14-continued

Target sequences.

| SEQ ID NO: | Description | Sequence |
|---|---|---|
| | | TTCCCGATGGGAATGGGCTGGAAGACGGCAATGTCCGCCACCTGGTGCAGCCCAGAGGGTCAAGGAAT<br>GGGCCAGGGCCCTGGCAGGGAGGTCGGAGGAAATTCCGCCGCCAGCGGCCCCGCCTCTCCCATAAGGG<br>ACCCATGCCTTTCTGAAGCAGGACTGAAGGGGCCCCCAAGTGCCCACCCCCGGCGGTTATGTCTCCTC<br>CATAGATTGGTCTGCTTCTCTGGAGGCCTCACGTCCATTCAGCTCTCACCTCGCACCTGCTGTAGCCA<br>CCAGTGGGCCCAGCTCTTCTCACCTGCCTGCTTCCCCCAGTGGCGTGCTCCTGGCTGTAGTTTGGATG<br>ATTCCCGTTCTCTCACAAGAATCCGTCCAGTCCATCTTCCTGGCCCCTCCCTGGACTGACTTTGGAGA<br>CCTAGCCCCAGAAAGCCTCCCTTCTTCTCCAGGTCCCCTCCGCCCAGTCCCTGCCTGTCTCATCTAA<br>CGCCCCAAACCTTCATTTGGGCCTTCCTTCCTCATGTCTGCCCTGAGCGCGGGGTGGAAGTGCTCCCT<br>TCTGTGGGCTCCAGCAGATCCCTTGTTTTCCTGTCAGTTGGACCCCTCACCTGGCCTCCAGGGAAGAA<br>TGCAGAGAAAAGCAAGGAGAGACTCTAGTTAAGAGGTGCTGGCTGCGGGGATCCAGACAGGGCACATT<br>GGGGGCATGGAAGTGCCAGGGTGGTTTTCAGGGAGCTCTGGTGAAGTGGGTGGAGCATCAGCGTTTGCT<br>CAGTTAAGGGAGAGGTAGAGAGGGGCCCGTGAAGTCCTTTGTCACTTCTCTTGCCTTAGTGTGCCTCC<br>CAATACTCCCTTCTTCCTGCCCCCACACCCCATCCCCAGCTAGCCCAAGCTCCAGGTCAGGAGGGGAG<br>GGTGCTGGGCCTGACATGGCTATATACCCTCCCAGGAGTAAAAGCCAAGCAAGAGGTTGTTTTTGCCA<br>AGAATCACAGAATGTTAGAGCTGACAGGACCCTTGAAGGTCACTTAGCCTTCTTAGGCAAACGCCTGC<br>AAAACAGAAGCCTGGAGAGGGGAGTGACCTGCTCAGAGTCATTGCAGAGCCGGGATGGGGACCAGGTC<br>TCCCATCTCCTACTTTATGACGCCCTCTTCCCTCTTGATGATGTCTTTTCAAAGCAAATGAAGTGCCT<br>TTTCCCGAGGCTGGGGCTGGGGGTGGCTGGGAGGGGAAGGGAAGGGAGAGGCAAGCTGGCTGTGAACT<br>GTCCTGTTGTGGGGCTGGAGCTGCTCCCACCTCCCTGACCTACCCCTGCTGCACCATTCCCCCAGCTG<br>GGCTGGAAGGTTCCATAACTGGCCAGCTGCCCCCATAACTGGCAGCATTCCCAGACCCAGGGTACTCT<br>AATAGGGGCGGCTCAGGCACTGAGACTACCGCTCAACCCCAGGGTGGTTTTCAGGAGTCCGAGGTAGC<br>CTTCAATCACTGGACTCCATGGCCTTCCCTTCGTGTTGACCGGACCTTCCTTCCAGGGCTTTTCCTTT<br>GGGGGAGGCGGAGAGGGAGAAGAAGGAAGGGAAGGGCAGAAGGAAGGAGGGAAGAAAAGAAAGCAAA<br>GGAACAGAAGGAAGGAAAGAAAGATGGGAGGAAGTGCAGCAGGAATAGCACCCTCTCCCCGGGAGGCC<br>CTAGCTTCCGTGAGGGGCCATCACCAGCCATTCCTTGGAGGGGGCTTTCTCCCCTTTTGCTTGAGCAG<br>GGTTCCCAGGAGGGGAGAAAGAGAAGACAAGAGCCTGATGCCCAACTTTGTGTGTGGGGACGGGGGA<br>GTCAGGGCCCCCAAGTCCCACAATAGCCCCAATGTTTGCCTATCCACCTCCCCCAAGCCCCTTTACC<br>TATGCTGCTGCTAACGCTGCTGCTGCTGCTGCTGCTTAAAGGCTCATGCTTGGAGTGGGGACT<br>GGTCGGTGCCCAGAAAGTCTCTTCTGCCACTGACGCCCCCATCAGGGATTGGGCTTCTTTCCCCCTT<br>CCTTTCTGTGTCTCCTGCCTCATCGGCCTGCCATGACCTGCAGCCAAGCCCAGCCCCGTGGGGAAGGG<br>GAGAAAGTGGGGATGCTAAGAAAGCTGGGAGATAGGGAACAGAAGAGGGTAGTGGGTGGGCTAGGG<br>GGGCTGCCTTATTTAAAGTGGTTGTTTATGATTCTTATACTAATTTATACAAAGATATTAAGGCCCTG<br>TTCATTAAGAAATTGTTCCCTTCCCCTGTGTTCAATGTTTGTAAAGATTGTTCTGTGTAAATATGTCT<br>TTATAATAAACAGTTAAAAGCTGACAGTTCGCCCTTACTCTTGGAGGTCATGTTCAGGAGGGGCATTC<br>CTTTCCCCTGGGGGTCATGGGTGTCCCCATGCCCACATATTGCACGTGCAGGGAGGTAAGTGCCTGCA<br>TCCCAAATCGGTTCTAGGTCAACTGGCCTCAAACTGATTTGCCATGAGCTCACAAAATGAATCCCTAT<br>GCTTAATGACCAGGTCACATAAAATCCAGCCCACTTACAGGTTTTCTGGCATCTGTTTGGGTGTCCTA<br>ATTTTTTTGGCAGTGTCATTTGAAGAATTTTTTTAAAGCAGTTTATTTAAGAACATACTGATTAAATG<br>CAGGATGCGCTACTAAAAATTGTTTTGTATCCTTGGTGGGTGTCTTCTGCTATTTTATCTACTTTTGAA<br>CACTTTCAGGACTTTTTAGCCAGTTTGCCTTTCTTGAAAAATGTTATGTTTTCAGCAATAAATACATT<br>TGATAATGACTTTGTTTGTATCATTTTATGTTTCACAAAGTAGAGTTGCTTGATGAATGAGATAGCCT<br>GAAAAATAAAATGCAAAGAGTTCAATATAA |
| 7193 | Human KIF20A<br>transcript variant<br>1 mRNA<br>NM_005733.3<br>(GI: 1519313609<br>version 3) | GGAGTTGTGCTCTGCGGCTGCGAAAGTCCAGCTTCGGCGACTAGGTGTGAGTAAGCCAGTATCCCAGG<br>AGGAGCAAGTGGCACGTCTTCGGACCTAGGCTGCCCCTGCCGTCATGTCGCAAGGGATCCTTTCTCCG<br>CCAGCGGGCTTGCTGTCCGATGACGATGTCGTAGTTTCTCCCATGTTTGAGTCCACAGCTGCAGATTT<br>GGGGTCTGTGGTACGCAAGAACCTGCTATCAGACTGCTCTGTCGTCTCTACCTCCCTAGAGGACAAGC<br>AGCAGGTTCCATCTGAGGACAGTATGGAGAAGGTGAAAGTATACTTGAGGGTTAGGCCCTTGTTACCT<br>TCAGAGTTGGAACGACAGGAAGATCAGGGTTGTGTCCGTATTGAGAATGTGGAGACCCTTGTTCTACA<br>AGCACCCAAGGACTCTTTTGCCCTGAAGACAATGAACGGGGAATTGGCCAAGCCACACACAGGTTCA<br>CCTTTTCCCAGATCTTTGGGCCAGAAGTGGGACAGGCATCCTTCTTCAACCTAACTGTGAAGGAGATG<br>GTAAAGGATGTACTCAAAGGGCAGAACTGGCTCATCTATACATATGGAGTCACTAACTCAGGGAAAAC<br>CCACACGATTCAAGGTACCATCAAGGATGGAGGGATTCTCCCCGGTCCCTGGCGCTGATCTTCAATA<br>GCCTCCAAGGCCAACTTCATCCAACACCTGATCTGAAGCCCTTGCTCTCCAATGAGGTAATCTGGCTA<br>GACAGCAAGCAGATCCGACAGGAGGAAATGAAGAAGCTGTCCCTGCTAAATGGAGGCCTCCAAGAGGA<br>GGAGCTGTCCACTTCCTTGAAGAGGAGTGTCTACATCGAAAGTCGGATAGGTACCAGCACCAGCTTCG<br>ACAGTGGCATTGCTGGGCTCTCTTCTATCAGTCAGTGTACCAGCAGTAGCCAGCTGGATGAAACAAGT<br>CATCGATGGGCACAGCCAGACACTGCCCCACTACCTGTCCCGGCAAACATTCGCTTCTCCATCTGGAT<br>CTCATTCTTTGAGATCTACAACGAACTGCTTTATGACCTATTAGAACCGCCTAGCCAACAGCGCAAGA<br>GGCAGACTTTGCGGCTATGCGAGGATCAAAATGGCAATCCCTATGTGAAAGATCTCAACTGGATTCAT<br>GTGCAAGATGCTGAGGAGGCCTGGAAGCTCCTAAAAGTGGGTCGTAAGAACCAGAGCTTTGCCAGCAC<br>CCACCTCAACCAGAACTCCAGCCGCAGTCACAGCATCTTCTCAATCAGGATCCTACACCTTCAGGGGG<br>AAGGAGATATAGTCCCCAAGATCAGCGAGCTGTCACTCTGTGATCTGGCTGGCTCAGAGCGCTGCAAA<br>GATCAGAAGAGTGGTGAACGGTTGAAGGAAGCAGGAAACATTAACACCTCTCTACACACCCTGGGCCG<br>CTGTATTGCTGCCCTTCGTCAAAACCAGCAGAACCGGTCAAAGCAGAACCTGGTTCCCTTCCGTGACA<br>GCAAGTTGACTCGAGTGTTCCAAGGTTTCTTCACAGGCCGAGGCCGTTCCTGCATGATTGTCAATGTG<br>AATCCCTGTGCATCTACCTATGATGAAACTCTCATGTGGCCAAGTTCTCAGCCATTGCTAGCCAGCT<br>TGTGCATGCCCCACCTATGCAACTGGGATTCCCATCCCTGCACTCGTTCATCAAGGAACATAGTCTTC<br>AGGTATCCCCAGCTTAGAGAAAGGGCTAAGGCAGACACAGGCCTTGATGATGATATTGAAAATGAA<br>GCTGACATCTCCATGTATGGCAAAGAGGAGCTCCTACAAGTTGTGGAAGCCATGAAGACACTGCTTTT<br>GAAGGAACGACAGGAAAAGCTACAGCTGGAGATGCATCTCCGAGATGAAATTTGCAATGAGATGGTAG<br>AACAGATGCAACAGCGGGAACAGTGGTGCAGTGAACATTTGGACACCCAAAAGGAACTATTGGAGGAA<br>ATGTATGAAGAAAACTAAATATCCTCAAGGAGTCACTGACAAGTTTTTACCAAGAAGAGATTCAGGA<br>GCGGGATGAAAAGATTGAAGAGCTAGAAGCTCTCTTGCAGGAAGCCAGACAACAGTCAGTGGCCCATC<br>AGCAATCAGGGTCTGAATTGGCCCTACGGCGGTCACAAAGGTTGGCAGCTTCTGCCTCCACCCAGCAG<br>CTTCAGGAGGTTAAAGCTAAATTACAGCAGTGCAAAGCAGAGCTAAACTCTACCACTGAAGAGTTGCA |

TABLE 14-continued

Target sequences.

| SEQ ID NO: | Description | Sequence |
|---|---|---|
| | | TAAGTATCAGAAAATGTTAGAACCACCACCCTCAGCCAAGCCCTTCACCATTGATGTGGACAAGAAGT
TAGAAGAGGGCCAGAAGAATATAAGGCTGTTGCGGACAGAGCTTCAGAAACTTGGTGAGTCTCTCCAA
TCAGCAGAGAGAGCTTGTTGCCACAGCACTGGGGCAGGAAAACTTCGTCAAGCCTTGACCACTTGTGA
TGACATCTTAATCAAACAGGACCAGACTCTGGCTGAACTGCAGAACAACATGGTGCTAGTGAAACTGG
ACCTTCGGAAGAAGGCAGCATGTATTGCTGAGCAGTATCATACTGTGTTGAAACTCCAAGGCCAGGTT
TCTGCCAAAAAGCGCCTTGGTACCAACCAGGAAAATCAGCAACCAAACCAACAACCACCAGGGAAGAA
ACCATTCCTTCGAAATTTACTTCCCCGAACACCAACCTGCCAAAGCTCAACAGACTGCAGCCCTTATG
CCCGGATCCTACGCTCACGGCGTTCCCCTTTACTCAAATCTGGGCCTTTTGGCAAAAGTACTAAGGC
TGTGGGGAAAGAGAAGAGCAGTCATGGCCCTGAGGTGGGTCAGCTACTCTCCTGAAGAAATAGGTCTC
TTTTATGCTTTACCATATATCAGGAATTATATCCAGGATGCAATACTCAGACACTAGCTTTTTTCTCA
CTTTTGTATTATAACCACCTATGTAATCTCATGTTGTTGTTTTTTTTTATTTACTTATATGATTTCTA
TGCACACAAAAACAGTTATATTAAAGATATTATTGTTCACATTTTTTATTGAATTCCAAATGTAGCAA
AATCATTAAAACAAATTATAAAAGGGACAGAAAAA |
| 7194 | Human LTB transcript variant 1 mRNA NM_002341.2 (GI: 1720810086 version 2) | AGTCTCAATGGGGGCACTGGGGCTGGAGGGCAGGGGTGGGAGGCTCCAGGGGAGGGGTTCCCTCCTGC
TAGCTGTGGCAGGAGCCACTTCTCTGGTGACCTTGTTGCTGGCGGTGCCTATCACTGTCCTGGCTGTG
CTGGCCTTTAGTGCCCCAGGATCAGGGAGGACTGGTAACGGAGACGGCCGACCCCGGGGCACAGGCCCA
GCAAGGACTGGGGTTTCAGAAGCTGCCAGAGGAGGAGCCAGAAACAGATCTCAGCCCCGGGCTCCCAG
CTGCCCACCTCATAGGCGCTCCGCTGAAGGGGCAGGGGCTAGGCTGGGAGACGACGAAGGAACAGGCG
TTTCTGACGAGCGGGACGCAGTTCTCGGACGCCGAGGGGCTGGCGCTCCCGCAGGACGGCCTCTATTA
CCTCTACTGTCTCGTCGGCTACCGGGGCCGGGCGCCCCCTGGCGGCGGGGACCCCCAGGGCCGCTCGG
TCACGCTGCGCAGCTCTCTGTACCGGGCGGGGGCGCCTACGGGCCGGGCACTCCCGAGCTGCTGCTC
GAGGGCGCCGAGACGGTGACTCCAGTGCTGGACCCGGCCAGGAGACAAGGGTACGGGCCTCTCTGGTA
CACGAGCGTGGGGTTCGGCGGCCTGGTGCAGCTCCGGAGGGGCGAGAGGGTGTACGTCAACATCAGTC
ACCCCGATATGGTGGACTTCGCGAGAGGGAAGACCTTCTTTGGGGCCGTGATGGTGGGGTGAGGGAAT
ATGAGTGCGTGGTGCGAGTGCGTGAATATTGGGGGCCCGGACGCCCAGGACCCCATGGCAGTGGGAAA
AATGTAGGAGACTGTTTGGAAATTGATTTTGAACCTGATGAAAATAAAGAATGGAAAGCTTCAGTGCT
GCCGATAAA |
| 7195 | Human LTB transcript variant 2 mRNA NM_009588.1 (GI: 6996015, version 1) | CAGTCTCAATGGGGGCACTGGGGCTGGAGGGCAGGGGTGGGAGGCTCCAGGGGAGGGGTTCCCTCCTG
CTAGCTGTGGCAGGAGCCACTTCTCTGGTGACCTTGTTGCTGGCGGTGCCTATCACTGTCCTGGCTGT
GCTGGCCTTAGTGCCCCAGGATCAGGGAGGACTGGGTTTCAGAAGCTGCCAGAGGAGGAGCCAGAAAC
AGATCTCAGCCCCGGGCTCCCAGCTGCCCACCTCATAGGCGCTCCGCTGAAGGGGCAGGGGCTAGGCT
GGGAGACGACGAAGGAACAGGCGTTTCTGACGAGCGGGACGCAGTTCTCGGACGCCGAGGGGCTGGCG
CTCCCGCAGGACGGCCTCTATTACCTCTACTGTCTCGTCGGCTACCGGGGCCGGGCGCCCCCTGGCGG
CGGGGACCCCCAGGGCCGCTCGGTCACGCTGCGCAGCTCTCTGTACCGGGCGGGGGCGCCTACGGGC
CGGGCACTCCCGAGCTGCTGCTCGAGGGCGCCGAGACGGTGACTCCAGTGCTGGACCCGGCCAGGAGA
CAAGGGTACGGGCCTCTCTGGTACACGAGCGTGGGGTTCGGCGGCCTGGTGCAGCTCCGGAGGGGCGA
GAGGGTGTACGTCAACATCAGTCACCCCGATATGGTGGACTTCGCGAGAGGGAAGACCTTCTTTGGGG
CCGTGATGGTGGGGTGAGGGAATATGAGTGCGTGGTGCGAGTGCGTGAATATTGGGGCCCGGACGCC
CAGGACCCCATGGCAGTGGGAAAAATGTAGGAGACTGTTTGGAAATTGATTTTGAACCTGATGAAAAT
AAAGAATGGAAAGCTTCAGTGCTGCCGATAAA |

SEQUENCE LISTING (7195 sequences)

SEQ ID NO: 1 - RNA, 21 nt, Artificial Sequence
  Synthetic construct
uucagaguugagcaguagccg

SEQ ID NO: 2 - RNA, 21 nt, Artificial Sequence
  Synthetic construct
uugagggaguaauagaagccu

SEQ ID NO: 3 - RNA, 21 nt, Artificial Sequence
  Synthetic construct
uucugcaguggcaucugucag

SEQ ID NO: 4 - RNA, 21 nt, Artificial Sequence
  Synthetic construct
uacagcuugaguucgcugggc

SEQ ID NO: 5 - RNA, 21 nt, Artificial Sequence
  Synthetic construct
uuacagcuugaguucgcuggg

SEQ ID NO: 6 - RNA, 21 nt, Artificial Sequence
  Synthetic construct
uuagaggcagucaaugucgug

SEQ ID NO: 7 - RNA, 21 nt, Artificial Sequence
  Synthetic construct
uugaaguccauaaucaguggu

SEQ ID NO: 8 - RNA, 21 nt, Artificial Sequence
  Synthetic construct
ucgaauuuguucacgucguug

SEQ ID NO: 9 - RNA, 21 nt, Artificial Sequence
  Synthetic construct
uguguaaacaguuccugaugc

SEQ ID NO: 10 - RNA, 21 nt, Artificial Sequence
  Synthetic construct
ucugguguagaauccgcagcu

SEQ ID NO: 11 - RNA, 21 nt, Artificial Sequence
  Synthetic construct
ucaaggagagccagagcagca

SEQ ID NO: 12 - RNA, 21 nt, Artificial Sequence
  Synthetic construct
uaauugacuuguuucaucuag

SEQ ID NO: 13 - RNA, 21 nt, Artificial Sequence
  Synthetic construct
ugacuuagugggggucggagu

SEQ ID NO: 14 - RNA, 21 nt, Artificial Sequence
  Synthetic construct
auagaugucgucacaguccag

SEQ ID NO: 15 - RNA, 21 nt, Artificial Sequence
  Synthetic construct
uauuauguuauuauuacacug

SEQ ID NO: 16 - RNA, 21 nt, Artificial Sequence
  Synthetic construct
uuguagucauuccagccgcgg

SEQ ID NO: 17 - RNA, 21 nt, Artificial Sequence
  Synthetic construct
uuauugagaccuucagucccu

SEQ ID NO: 18 - RNA, 21 nt, Artificial Sequence
  Synthetic construct
uagaaccaugugccucucgga

SEQ ID NO: 19 - RNA, 21 nt, Artificial Sequence
  Synthetic construct
uauugagaccuucagucccua

SEQ ID NO: 20 - RNA, 21 nt, Artificial Sequence
  Synthetic construct
ucacacugcacugcucagcuu

SEQ ID NO: 21 - RNA, 21 nt, Artificial Sequence
  Synthetic construct
uucugcaccugacuccaggug

SEQ ID NO: 22 - RNA, 21 nt, Artificial Sequence
  Synthetic construct
ucgaagguagagaacuucugg

SEQ ID NO: 23 - RNA, 21 nt, Artificial Sequence
  Synthetic construct
ucagcuuagcacacuagggug

SEQ ID NO: 24 - RNA, 21 nt, Artificial Sequence
  Synthetic construct
uaggacaccaucagcagggga

SEQ ID NO: 25 - RNA, 21 nt, Artificial Sequence
  Synthetic construct
uuuauugagaccuucaguccc

SEQ ID NO: 26 - RNA, 21 nt, Artificial Sequence
  Synthetic construct
uuggaggcaacucauucucau

SEQ ID NO: 27 - RNA, 21 nt, Artificial Sequence
  Synthetic construct
uauguuauuauuacacugucu

SEQ ID NO: 28 - RNA, 21 nt, Artificial Sequence
  Synthetic construct
ucgcagcucauacuucugcuu

SEQ ID NO: 29 - RNA, 21 nt, Artificial Sequence
  Synthetic construct
uagaugucgucacaguccagg

SEQ ID NO: 30 - RNA, 21 nt, Artificial Sequence
  Synthetic construct
uuauguuauuauuacacuguc

SEQ ID NO: 31 - RNA, 21 nt, Artificial Sequence
  Synthetic construct
uuggugcucgggaaucagcag

SEQ ID NO: 32 - RNA, 21 nt, Artificial Sequence
  Synthetic construct
uaaaccucucaacacccagag

SEQ ID NO: 33 - RNA, 21 nt, Artificial Sequence
  Synthetic construct
uaguagaagcccuuccacugg

SEQ ID NO: 34 - RNA, 21 nt, Artificial Sequence
  Synthetic construct
uguaaggaguuggugcucggg

SEQ ID NO: 35 - RNA, 21 nt, Artificial Sequence
  Synthetic construct
aucagcagaagcaugcaucag

SEQ ID NO: 36 - RNA, 21 nt, Artificial Sequence
  Synthetic construct
uguuauuauuacacugucuuu

SEQ ID NO: 37 - RNA, 21 nt, Artificial Sequence
  Synthetic construct
uucauucagguucugaagguu

SEQ ID NO: 38 - RNA, 21 nt, Artificial Sequence
  Synthetic construct
uucugcacaaagagguccugg

SEQ ID NO: 39 - RNA, 21 nt, Artificial Sequence
  Synthetic construct
ucuccagagcaucuccucgga

SEQ ID NO: 40 - RNA, 21 nt, Artificial Sequence
  Synthetic construct
uuugagagcagcccagaggag

SEQ ID NO: 41 - RNA, 21 nt, Artificial Sequence
  Synthetic construct
uugagggaguaguagaagccc

SEQ ID NO: 42 - RNA, 21 nt, Artificial Sequence
  Synthetic construct
uaugauagugaggugggcugg

SEQ ID NO: 43 - RNA, 21 nt, Artificial Sequence
  Synthetic construct
uagaauacaccaugggcccug

SEQ ID NO: 44 - RNA, 21 nt, Artificial Sequence
  Synthetic construct
uguaacuucagguguagggga

SEQ ID NO: 45 - RNA, 21 nt, Artificial Sequence
  Synthetic construct
uuguaaggaguuggugcucgg

SEQ ID NO: 46 - RNA, 21 nt, Artificial Sequence
  Synthetic construct
uuguucucaaaguccuccaag

SEQ ID NO: 47 - RNA, 21 nt, Artificial Sequence
  Synthetic construct
ugagggaguaguagaagcccu

SEQ ID NO: 48 - RNA, 21 nt, Artificial Sequence
  Synthetic construct
uucugcuucagugucaggagg

SEQ ID NO: 49 - RNA, 21 nt, Artificial Sequence
  Synthetic construct
auacuucugcuucagugucag

SEQ ID NO: 50 - RNA, 21 nt, Artificial Sequence
  Synthetic construct
uuauuauuacacugucuuuuu

SEQ ID NO: 51 - RNA, 21 nt, Artificial Sequence
  Synthetic construct
augucgucacaguccaggggu

SEQ ID NO: 52 - RNA, 21 nt, Artificial Sequence
  Synthetic construct
auguuauuauuacacugucuu

SEQ ID NO: 53 - RNA, 21 nt, Artificial Sequence
  Synthetic construct
ucugcgcugaccgcguucggg

SEQ ID NO: 54 - RNA, 21 nt, Artificial Sequence
  Synthetic construct
uuccacgguacucaccacagg

SEQ ID NO: 55 - RNA, 21 nt, Artificial Sequence
  Synthetic construct
aagguuuauugagaccuucag

SEQ ID NO: 56 - RNA, 21 nt, Artificial Sequence
  Synthetic construct
uaaggaguuggugcucgggaa

SEQ ID NO: 57 - RNA, 21 nt, Artificial Sequence
  Synthetic construct
ugucaggaggugcauguucug

SEQ ID NO: 58 - RNA, 21 nt, Artificial Sequence
  Synthetic construct
auuauguuauuauuacacugu

SEQ ID NO: 59 - RNA, 21 nt, Artificial Sequence
  Synthetic construct
uccuccucugcgcugaccgcg

SEQ ID NO: 60 - RNA, 21 nt, Artificial Sequence
  Synthetic construct
ugaagguuuauugagaccuuc

SEQ ID NO: 61 - RNA, 21 nt, Artificial Sequence
  Synthetic construct
aagauggaccacaaaggccug

SEQ ID NO: 62 - RNA, 21 nt, Artificial Sequence
  Synthetic construct
uucagugucaggaggugcaug

SEQ ID NO: 63 - RNA, 21 nt, Artificial Sequence
  Synthetic construct
uagaugagguacacgccgucu

SEQ ID NO: 64 - RNA, 21 nt, Artificial Sequence
  Synthetic construct
ucauacuucugcuucaguguc

SEQ ID NO: 65 - RNA, 21 nt, Artificial Sequence
  Synthetic construct
uuaggaauggaugcccugggu

SEQ ID NO: 66 - RNA, 21 nt, Artificial Sequence
  Synthetic construct
auggagaccauggguguccag

SEQ ID NO: 67 - RNA, 21 nt, Artificial Sequence
  Synthetic construct
uacuucugcuucagugucagg

SEQ ID NO: 68 - RNA, 21 nt, Artificial Sequence
  Synthetic construct
uucaugcugucaguucugcuc

SEQ ID NO: 69 - RNA, 21 nt, Artificial Sequence
  Synthetic construct
aagcaggacaagauggaccac

SEQ ID NO: 70 - RNA, 21 nt, Artificial Sequence
  Synthetic construct
auucucauggagcccagccag

SEQ ID NO: 71 - RNA, 21 nt, Artificial Sequence
  Synthetic construct
ugcggaaccagaaggcuccug

SEQ ID NO: 72 - RNA, 21 nt, Artificial Sequence
  Synthetic construct
agagauuguccucugcucccu

SEQ ID NO: 73 - RNA, 21 nt, Artificial Sequence
  Synthetic construct
aaguccuccaaguccacucgc

SEQ ID NO: 74 - RNA, 21 nt, Artificial Sequence
  Synthetic construct
uccaaguccacucgcagcuca

SEQ ID NO: 75 - RNA, 21 nt, Artificial Sequence
  Synthetic construct
uucagucccuacccacuccca

SEQ ID NO: 76 - RNA, 21 nt, Artificial Sequence
  Synthetic construct
uguucacacugcacugcucag

SEQ ID NO: 77 - RNA, 21 nt, Artificial Sequence
  Synthetic construct
uaggaauggaugcccugggug

SEQ ID NO: 78 - RNA, 21 nt, Artificial Sequence
  Synthetic construct
aaccucucaacacccagaggg

SEQ ID NO: 79 - RNA, 21 nt, Artificial Sequence
  Synthetic construct
ugggcauagaugucgucacag

SEQ ID NO: 80 - RNA, 21 nt, Artificial Sequence
  Synthetic construct
ugggacaugguuugagagcag

SEQ ID NO: 81 - RNA, 21 nt, Artificial Sequence
  Synthetic construct
uccacgguacucaccacaggg

SEQ ID NO: 82 - RNA, 21 nt, Artificial Sequence
  Synthetic construct
aagaccucauaugcaugccua

SEQ ID NO: 83 - RNA, 21 nt, Artificial Sequence
  Synthetic construct
agcuuguagucauuccagccg

SEQ ID NO: 84 - RNA, 21 nt, Artificial Sequence
  Synthetic construct
ucaugcugucaguucugcuca

SEQ ID NO: 85 - RNA, 21 nt, Artificial Sequence
  Synthetic construct
uguugggacagguuggaggca

SEQ ID NO: 86 - RNA, 21 nt, Artificial Sequence
  Synthetic construct
aagcugaguaugauagugagg

SEQ ID NO: 87 - RNA, 21 nt, Artificial Sequence
  Synthetic construct
uguuguucucaaaguccucca

SEQ ID NO: 88 - RNA, 21 nt, Artificial Sequence
  Synthetic construct
ucugcuucagugucaggaggu

SEQ ID NO: 89 - RNA, 21 nt, Artificial Sequence
  Synthetic construct
uguuucaggguggugugcggu

SEQ ID NO: 90 - RNA, 21 nt, Artificial Sequence
  Synthetic construct
ugugccucucggaagaggccu

SEQ ID NO: 91 - RNA, 21 nt, Artificial Sequence
  Synthetic construct
uguagucauuccagccgcgga

SEQ ID NO: 92 - RNA, 21 nt, Artificial Sequence
  Synthetic construct
uauuauuauuauguuauuauu

SEQ ID NO: 93 - RNA, 21 nt, Artificial Sequence
  Synthetic construct
uauuauuauguuauuauuaca

SEQ ID NO: 94 - RNA, 21 nt, Artificial Sequence
  Synthetic construct
ucagucccuacccacucccag

SEQ ID NO: 95 - RNA, 21 nt, Artificial Sequence
  Synthetic construct
uuauuauguuauuauuacacu

SEQ ID NO: 96 - RNA, 21 nt, Artificial Sequence
  Synthetic construct
uaggacagggagucaccugcc

SEQ ID NO: 97 - RNA, 21 nt, Artificial Sequence
  Synthetic construct
uacucuccaucagcacggccg

SEQ ID NO: 98 - RNA, 21 nt, Artificial Sequence
  Synthetic construct
ugaguaugauagugagguggg

SEQ ID NO: 99 - RNA, 21 nt, Artificial Sequence
  Synthetic construct
auggagaagucagcguacuug

SEQ ID NO: 100 - RNA, 21 nt, Artificial Sequence
  Synthetic construct
augauagugaggugggcuggg

SEQ ID NO: 101 - RNA, 21 nt, Artificial Sequence
  Synthetic construct
ugguaggacagggagucaccu

SEQ ID NO: 102 - RNA, 21 nt, Artificial Sequence
  Synthetic construct
ugucaguucugcucagagugg

SEQ ID NO: 103 - RNA, 21 nt, Artificial Sequence
  Synthetic construct
ucucaaaguccuccaagucca

SEQ ID NO: 104 - RNA, 21 nt, Artificial Sequence
  Synthetic construct
ucugaagguuuauugagaccu

SEQ ID NO: 105 - RNA, 21 nt, Artificial Sequence
  Synthetic construct
auuauuauuauguuauuauua

SEQ ID NO: 106 - RNA, 21 nt, Artificial Sequence
  Synthetic construct
uacacgccgucugacugguag

SEQ ID NO: 107 - RNA, 21 nt, Artificial Sequence
  Synthetic construct
uuguccucugcucccucaugu

SEQ ID NO: 108 - RNA, 21 nt, Artificial Sequence
  Synthetic construct
ugugaaauacaagguucccuu

SEQ ID NO: 109 - RNA, 21 nt, Artificial Sequence
  Synthetic construct
uccuggucccggucgaaggua

SEQ ID NO: 110 - RNA, 21 nt, Artificial Sequence
  Synthetic construct
agcagaagcaugcaucagggg

SEQ ID NO: 111 - RNA, 21 nt, Artificial Sequence
  Synthetic construct
gaugucgucacaguccagggg

SEQ ID NO: 112 - RNA, 21 nt, Artificial Sequence
  Synthetic construct
augagguacacgccgucugac

SEQ ID NO: 113 - RNA, 21 nt, Artificial Sequence
  Synthetic construct
uuucaggguggugugcgguag

SEQ ID NO: 114 - RNA, 21 nt, Artificial Sequence
  Synthetic construct
uccacagugaggaagcaggac

SEQ ID NO: 115 - RNA, 21 nt, Artificial Sequence
  Synthetic construct
uuugagggaguaguagaagcc

SEQ ID NO: 116 - RNA, 21 nt, Artificial Sequence
  Synthetic construct
ucggaucccggagaccugggg

SEQ ID NO: 117 - RNA, 21 nt, Artificial Sequence
  Synthetic construct
uucccuucugcaccugacucc

SEQ ID NO: 118 - RNA, 21 nt, Artificial Sequence
  Synthetic construct
ugcagagauuguccucugcuc

SEQ ID NO: 119 - RNA, 21 nt, Artificial Sequence
  Synthetic construct
aucucagugcguuugagggag

SEQ ID NO: 120 - RNA, 21 nt, Artificial Sequence
  Synthetic construct
ucgguggucaugucacagaag

SEQ ID NO: 121 - RNA, 21 nt, Artificial Sequence
  Synthetic construct
cugaguaugauagugaggugg

SEQ ID NO: 122 - RNA, 21 nt, Artificial Sequence
  Synthetic construct
ugaaauacaagguucccuucu

SEQ ID NO: 123 - RNA, 21 nt, Artificial Sequence
  Synthetic construct
agguucugaagguuuauugag

SEQ ID NO: 124 - RNA, 21 nt, Artificial Sequence
  Synthetic construct
uggucaugucacagaagacgg

SEQ ID NO: 125 - RNA, 21 nt, Artificial Sequence
  Synthetic construct
uuccagccgcggaagaaacuu

SEQ ID NO: 126 - RNA, 21 nt, Artificial Sequence
  Synthetic construct
ugauagugaggugggcugggg

SEQ ID NO: 127 - RNA, 21 nt, Artificial Sequence
  Synthetic construct
caugcugucaguucugcucag

SEQ ID NO: 128 - RNA, 21 nt, Artificial Sequence
  Synthetic construct
ucagcuguugggacagguugg

SEQ ID NO: 129 - RNA, 21 nt, Artificial Sequence
  Synthetic construct
acaugguuugagagcagccca

SEQ ID NO: 130 - RNA, 21 nt, Artificial Sequence
  Synthetic construct
uaaguuggugggagggaugcu

SEQ ID NO: 131 - RNA, 21 nt, Artificial Sequence
  Synthetic construct
caagguucccuucugcaccug

SEQ ID NO: 132 - RNA, 21 nt, Artificial Sequence
  Synthetic construct
cucagcuuagcacacuagggu

SEQ ID NO: 133 - RNA, 21 nt, Artificial Sequence
  Synthetic construct
agagcaucuccucggaucccg

SEQ ID NO: 134 - RNA, 21 nt, Artificial Sequence
  Synthetic construct
uccucggaucccggagaccug

SEQ ID NO: 135 - RNA, 21 nt, Artificial Sequence
  Synthetic construct
cauagaugucgucacagucca

SEQ ID NO: 136 - RNA, 21 nt, Artificial Sequence
  Synthetic construct
aaccagaaggcuccugaggag

SEQ ID NO: 137 - RNA, 21 nt, Artificial Sequence
  Synthetic construct
cuuguagucauuccagccgcg

SEQ ID NO: 138 - RNA, 21 nt, Artificial Sequence
  Synthetic construct
aggccugugaaauacaagguu

SEQ ID NO: 139 - RNA, 21 nt, Artificial Sequence
  Synthetic construct
ucccuucugcaccugacucca

SEQ ID NO: 140 - RNA, 21 nt, Artificial Sequence
  Synthetic construct
ugugguaggacagggagucac

SEQ ID NO: 141 - RNA, 21 nt, Artificial Sequence
  Synthetic construct
ugaggaagcaggacaagaugg

SEQ ID NO: 142 - RNA, 21 nt, Artificial Sequence
  Synthetic construct
agcaucuccucggaucccgga

SEQ ID NO: 143 - RNA, 21 nt, Artificial Sequence
  Synthetic construct
agaaccaugugccucucggaa

SEQ ID NO: 144 - RNA, 21 nt, Artificial Sequence
  Synthetic construct
uggugcucgggaaucagcaga

SEQ ID NO: 145 - RNA, 21 nt, Artificial Sequence
  Synthetic construct
guucugcacaaagagguccug

SEQ ID NO: 146 - RNA, 21 nt, Artificial Sequence
  Synthetic construct
gucgaagguagagaacuucug

SEQ ID NO: 147 - RNA, 21 nt, Artificial Sequence
  Synthetic construct
agguacacgccgucugacugg

SEQ ID NO: 148 - RNA, 21 nt, Artificial Sequence
  Synthetic construct
aacucauucucauggagccca

SEQ ID NO: 149 - RNA, 21 nt, Artificial Sequence
  Synthetic construct
augcugaagaugggacauggu

SEQ ID NO: 150 - RNA, 21 nt, Artificial Sequence
  Synthetic construct
ugcugaagaugggacaugguu

SEQ ID NO: 151 - RNA, 21 nt, Artificial Sequence
  Synthetic construct
ugcgcaguucugcacaaagag

SEQ ID NO: 152 - RNA, 21 nt, Artificial Sequence
  Synthetic construct
uagcccugggcauagaugucg

SEQ ID NO: 153 - RNA, 21 nt, Artificial Sequence
  Synthetic construct
aagacgggcacaggcacacug

SEQ ID NO: 154 - RNA, 21 nt, Artificial Sequence
  Synthetic construct
augcugucaguucugcucaga

SEQ ID NO: 155 - RNA, 21 nt, Artificial Sequence
  Synthetic construct
aaaguccuccaaguccacucg

SEQ ID NO: 156 - RNA, 21 nt, Artificial Sequence
  Synthetic construct
aguagaagcccuuccacuggg

SEQ ID NO: 157 - RNA, 21 nt, Artificial Sequence
  Synthetic construct
uguccucugcucccucaugug

SEQ ID NO: 158 - RNA, 21 nt, Artificial Sequence
  Synthetic construct
uccacucgcagcucauacuuc

SEQ ID NO: 159 - RNA, 21 nt, Artificial Sequence
  Synthetic construct
ucgggaaucagcagaagcaug

SEQ ID NO: 160 - RNA, 21 nt, Artificial Sequence
  Synthetic construct
aucagcacggccgaagcccag

SEQ ID NO: 161 - RNA, 21 nt, Artificial Sequence
  Synthetic construct
guuauuauuacacugucuuuu

SEQ ID NO: 162 - RNA, 21 nt, Artificial Sequence
  Synthetic construct
ugcgcugaccgcguucgggga

SEQ ID NO: 163 - RNA, 21 nt, Artificial Sequence
  Synthetic construct
acaaagagguccuggucccgg

SEQ ID NO: 164 - RNA, 21 nt, Artificial Sequence
  Synthetic construct
aaguuggugggagggaugcug

SEQ ID NO: 165 - RNA, 21 nt, Artificial Sequence
  Synthetic construct
ugcaccugacuccagguguaa

SEQ ID NO: 166 - RNA, 21 nt, Artificial Sequence
  Synthetic construct
ugcacugcucagcuuagcaca

SEQ ID NO: 167 - RNA, 21 nt, Artificial Sequence
  Synthetic construct
aguccuccaaguccacucgca

SEQ ID NO: 168 - RNA, 21 nt, Artificial Sequence
  Synthetic construct
uucacacugcacugcucagcu

SEQ ID NO: 169 - RNA, 21 nt, Artificial Sequence
  Synthetic construct
ucauaugcaugccuaccuugg

SEQ ID NO: 170 - RNA, 21 nt, Artificial Sequence
  Synthetic construct
ugaggagagagcugcgcaguu

SEQ ID NO: 171 - RNA, 21 nt, Artificial Sequence
  Synthetic construct
cagcucauacuucugcuucag

SEQ ID NO: 172 - RNA, 21 nt, Artificial Sequence
  Synthetic construct
ugucacagaagacgggcacag

SEQ ID NO: 173 - RNA, 21 nt, Artificial Sequence
  Synthetic construct
aaaccucucaacacccagagg

SEQ ID NO: 174 - RNA, 21 nt, Artificial Sequence
  Synthetic construct
ucugcaccugacuccaggugu

SEQ ID NO: 175 - RNA, 21 nt, Artificial Sequence
  Synthetic construct
acagugaggaagcaggacaag

SEQ ID NO: 176 - RNA, 21 nt, Artificial Sequence
  Synthetic construct
ugguuugagagcagcccagag

SEQ ID NO: 177 - RNA, 21 nt, Artificial Sequence
  Synthetic construct
ucugacugguagcccugggca

SEQ ID NO: 178 - RNA, 21 nt, Artificial Sequence
  Synthetic construct
ucaucucagugcguuugaggg

SEQ ID NO: 179 - RNA, 21 nt, Artificial Sequence
  Synthetic construct
ugaagaugggacaugguuuga

SEQ ID NO: 180 - RNA, 21 nt, Artificial Sequence
  Synthetic construct
cagcuuagcacacuagggugg

SEQ ID NO: 181 - RNA, 21 nt, Artificial Sequence
  Synthetic construct
ucugcacaaagagguccuggu

SEQ ID NO: 182 - RNA, 21 nt, Artificial Sequence
  Synthetic construct
ugccucucggaagaggccugg

SEQ ID NO: 183 - RNA, 21 nt, Artificial Sequence
  Synthetic construct
ugcucagcuuagcacacuagg

SEQ ID NO: 184 - RNA, 21 nt, Artificial Sequence
  Synthetic construct
acuucugcuucagugucagga

SEQ ID NO: 185 - RNA, 21 nt, Artificial Sequence
  Synthetic construct
auuauuauguuauuauuacac

SEQ ID NO: 186 - RNA, 21 nt, Artificial Sequence
  Synthetic construct
ucaugucacagaagacgggca

SEQ ID NO: 187 - RNA, 21 nt, Artificial Sequence
  Synthetic construct
agaugagguacacgccgucug

SEQ ID NO: 188 - RNA, 21 nt, Artificial Sequence
  Synthetic construct
guuguucucaaaguccuccaa

SEQ ID NO: 189 - RNA, 21 nt, Artificial Sequence
  Synthetic construct
ucaacacccagaggguauggg

SEQ ID NO: 190 - RNA, 21 nt, Artificial Sequence
  Synthetic construct
auucagguucugaagguuuau

SEQ ID NO: 191 - RNA, 21 nt, Artificial Sequence
  Synthetic construct
cugaagguuuauugagaccuu

SEQ ID NO: 192 - RNA, 21 nt, Artificial Sequence
  Synthetic construct
uggagagaagcagcagcagcg

SEQ ID NO: 193 - RNA, 21 nt, Artificial Sequence
  Synthetic construct
ucaaaguccuccaaguccacu

SEQ ID NO: 194 - RNA, 21 nt, Artificial Sequence
  Synthetic construct
uugagagcagcccagaggagu

SEQ ID NO: 195 - RNA, 21 nt, Artificial Sequence
  Synthetic construct
uuggugggagggaugcugaag

SEQ ID NO: 196 - RNA, 21 nt, Artificial Sequence
  Synthetic construct
uagucauuccagccgcggaag

SEQ ID NO: 197 - RNA, 21 nt, Artificial Sequence
  Synthetic construct
auggaccacaaaggccugcag

SEQ ID NO: 198 - RNA, 21 nt, Artificial Sequence
  Synthetic construct
aauacaagguucccuucugca

SEQ ID NO: 199 - RNA, 21 nt, Artificial Sequence
  Synthetic construct
caugguuugagagcagcccag

SEQ ID NO: 200 - RNA, 21 nt, Artificial Sequence
  Synthetic construct
ucauucagguucugaagguuu

SEQ ID NO: 201 - RNA, 21 nt, Artificial Sequence
  Synthetic construct
uuauuauuauguuauuauuac

SEQ ID NO: 202 - RNA, 21 nt, Artificial Sequence
  Synthetic construct
aggcaacucauucucauggag

SEQ ID NO: 203 - RNA, 21 nt, Artificial Sequence
  Synthetic construct
uggagaagucagcguacuugg

SEQ ID NO: 204 - RNA, 21 nt, Artificial Sequence
  Synthetic construct
aguacucuccaucagcacggc

SEQ ID NO: 205 - RNA, 21 nt, Artificial Sequence
  Synthetic construct
auacaagguucccuucugcac

SEQ ID NO: 206 - RNA, 21 nt, Artificial Sequence
  Synthetic construct
acugcucagcuuagcacacua

SEQ ID NO: 207 - RNA, 21 nt, Artificial Sequence
  Synthetic construct
cuagaauacaccaugggcccu

SEQ ID NO: 208 - RNA, 21 nt, Artificial Sequence
  Synthetic construct
ucagcagaagcaugcaucagg

SEQ ID NO: 209 - RNA, 21 nt, Artificial Sequence
  Synthetic construct
uccugaggagagagcugcgca

SEQ ID NO: 210 - RNA, 21 nt, Artificial Sequence
  Synthetic construct
auccuccucugcgcugaccgc

SEQ ID NO: 211 - RNA, 21 nt, Artificial Sequence
  Synthetic construct
cuccagagcaucuccucggau

SEQ ID NO: 212 - RNA, 21 nt, Artificial Sequence
  Synthetic construct
agugccuucaugcugucaguu

SEQ ID NO: 213 - RNA, 21 nt, Artificial Sequence
  Synthetic construct
cacacugcacugcucagcuua

SEQ ID NO: 214 - RNA, 21 nt, Artificial Sequence
  Synthetic construct
cucuccagagcaucuccucgg

SEQ ID NO: 215 - RNA, 21 nt, Artificial Sequence
  Synthetic construct
aaauacaagguucccuucugc

SEQ ID NO: 216 - RNA, 21 nt, Artificial Sequence
  Synthetic construct
uggaggcaacucauucucaug

SEQ ID NO: 217 - RNA, 21 nt, Artificial Sequence
  Synthetic construct
uucagguucugaagguuuauu

SEQ ID NO: 218 - RNA, 21 nt, Artificial Sequence
  Synthetic construct
cugcucagcuuagcacacuag

SEQ ID NO: 219 - RNA, 21 nt, Artificial Sequence
  Synthetic construct
cacaaagagguccuggucccg

SEQ ID NO: 220 - RNA, 21 nt, Artificial Sequence
  Synthetic construct
uacaccaugggcccuguucac

SEQ ID NO: 221 - RNA, 21 nt, Artificial Sequence
  Synthetic construct
ucaggaggugcauguucugca

SEQ ID NO: 222 - RNA, 21 nt, Artificial Sequence
  Synthetic construct
ugucagcuguugggacagguu

SEQ ID NO: 223 - RNA, 21 nt, Artificial Sequence
  Synthetic construct
agcagagggagcacucaugga

SEQ ID NO: 224 - RNA, 21 nt, Artificial Sequence
  Synthetic construct
gagaccuucagucccuaccca

SEQ ID NO: 225 - RNA, 21 nt, Artificial Sequence
  Synthetic construct
acucgcagcucauacuucugc

SEQ ID NO: 226 - RNA, 21 nt, Artificial Sequence
  Synthetic construct
acucauucucauggagcccag

SEQ ID NO: 227 - RNA, 21 nt, Artificial Sequence
  Synthetic construct
uggucccggucgaagguagag

SEQ ID NO: 228 - RNA, 21 nt, Artificial Sequence
  Synthetic construct
cugugaaauacaagguucccu

SEQ ID NO: 229 - RNA, 21 nt, Artificial Sequence
  Synthetic construct
uacccacucccagcccugcag

SEQ ID NO: 230 - RNA, 21 nt, Artificial Sequence
  Synthetic construct
uucucaaaguccuccaagucc

SEQ ID NO: 231 - RNA, 21 nt, Artificial Sequence
  Synthetic construct
agccgcggaagaaacuuacug

SEQ ID NO: 232 - RNA, 21 nt, Artificial Sequence
  Synthetic construct
agaugucgucacaguccaggg

SEQ ID NO: 233 - RNA, 21 nt, Artificial Sequence
  Synthetic construct
agcacucauggagaccauggg

SEQ ID NO: 234 - RNA, 21 nt, Artificial Sequence
  Synthetic construct
acucuccaucagcacggccga

SEQ ID NO: 235 - RNA, 21 nt, Artificial Sequence
  Synthetic construct
cuucagugucaggaggugcau

SEQ ID NO: 236 - RNA, 21 nt, Artificial Sequence
  Synthetic construct
gaagcugaguaugauagugag

SEQ ID NO: 237 - RNA, 21 nt, Artificial Sequence
  Synthetic construct
caggaggugcauguucugcag

SEQ ID NO: 238 - RNA, 21 nt, Artificial Sequence
  Synthetic construct
caucucagugcguuugaggga

SEQ ID NO: 239 - RNA, 21 nt, Artificial Sequence
  Synthetic construct
aguguaacuucagguguaggg

SEQ ID NO: 240 - RNA, 21 nt, Artificial Sequence
  Synthetic construct
acaagguucccuucugcaccu

SEQ ID NO: 241 - RNA, 21 nt, Artificial Sequence
  Synthetic construct
agguuuauugagaccuucagu

SEQ ID NO: 242 - RNA, 21 nt, Artificial Sequence
  Synthetic construct
cuccucugcgcugaccgcguu

SEQ ID NO: 243 - RNA, 21 nt, Artificial Sequence
  Synthetic construct
auuguccucugcucccucaug

SEQ ID NO: 244 - RNA, 21 nt, Artificial Sequence
  Synthetic construct
cacucgcagcucauacuucug

SEQ ID NO: 245 - RNA, 21 nt, Artificial Sequence
  Synthetic construct
uccacuucccgcccucggugg

SEQ ID NO: 246 - RNA, 21 nt, Artificial Sequence
  Synthetic construct
caggcuagaaccaugugccuc

SEQ ID NO: 247 - RNA, 21 nt, Artificial Sequence
  Synthetic construct
aaagagguccuggucccgguc

SEQ ID NO: 248 - RNA, 21 nt, Artificial Sequence
  Synthetic construct
cucgggaaucagcagaagcau

SEQ ID NO: 249 - RNA, 21 nt, Artificial Sequence
  Synthetic construct
acgggcacaggcacacugggg

SEQ ID NO: 250 - RNA, 21 nt, Artificial Sequence
  Synthetic construct
cucuccaucagcacggccgaa

SEQ ID NO: 251 - RNA, 21 nt, Artificial Sequence
  Synthetic construct
ucagguucugaagguuuauug

SEQ ID NO: 252 - RNA, 21 nt, Artificial Sequence
  Synthetic construct
aguucugcacaaagagguccu

SEQ ID NO: 253 - RNA, 21 nt, Artificial Sequence
  Synthetic construct
uagaagcccuuccacugggcc

SEQ ID NO: 254 - RNA, 21 nt, Artificial Sequence
  Synthetic construct
aguaugauagugaggugggcu

SEQ ID NO: 255 - RNA, 21 nt, Artificial Sequence
  Synthetic construct
acagguuggaggcaacucauu

SEQ ID NO: 256 - RNA, 21 nt, Artificial Sequence
  Synthetic construct
accaugugccucucggaagag

SEQ ID NO: 257 - RNA, 21 nt, Artificial Sequence
  Synthetic construct
agcuguugggacagguuggag

SEQ ID NO: 258 - RNA, 21 nt, Artificial Sequence
  Synthetic construct
accucuccagagcaucuccuc

SEQ ID NO: 259 - RNA, 21 nt, Artificial Sequence
  Synthetic construct
uccucugcgcugaccgcguuc

SEQ ID NO: 260 - RNA, 21 nt, Artificial Sequence
  Synthetic construct
ggucaugucacagaagacggg

SEQ ID NO: 261 - RNA, 21 nt, Artificial Sequence
  Synthetic construct
augguuugagagcagcccaga

SEQ ID NO: 262 - RNA, 21 nt, Artificial Sequence
  Synthetic construct
ucaggguggugugcgguagcu

SEQ ID NO: 263 - RNA, 21 nt, Artificial Sequence
  Synthetic construct
uacaagguucccuucugcacc

SEQ ID NO: 264 - RNA, 21 nt, Artificial Sequence
  Synthetic construct
aagagguccuggucccggucg

SEQ ID NO: 265 - RNA, 21 nt, Artificial Sequence
  Synthetic construct
uccagccgcggaagaaacuua

SEQ ID NO: 266 - RNA, 21 nt, Artificial Sequence
  Synthetic construct
cucauaugcaugccuaccuug

SEQ ID NO: 267 - RNA, 21 nt, Artificial Sequence
  Synthetic construct
aagguucccuucugcaccuga

SEQ ID NO: 268 - RNA, 21 nt, Artificial Sequence
  Synthetic construct
ugcugucaguucugcucagag

SEQ ID NO: 269 - RNA, 21 nt, Artificial Sequence
  Synthetic construct
aacacccagaggguaugggga

SEQ ID NO: 270 - RNA, 21 nt, Artificial Sequence
  Synthetic construct
guagaugagguacacgccguc

SEQ ID NO: 271 - RNA, 21 nt, Artificial Sequence
  Synthetic construct
uaggccguguuguucucaaag

SEQ ID NO: 272 - RNA, 21 nt, Artificial Sequence
  Synthetic construct
agaugggacaugguuugagag

SEQ ID NO: 273 - RNA, 21 nt, Artificial Sequence
  Synthetic construct
uuccacugggcccaguugaug

SEQ ID NO: 274 - RNA, 21 nt, Artificial Sequence
  Synthetic construct
cagcuguugggacagguugga

SEQ ID NO: 275 - RNA, 21 nt, Artificial Sequence
  Synthetic construct
agcccugcagagauuguccuc

SEQ ID NO: 276 - RNA, 21 nt, Artificial Sequence
  Synthetic construct
cauacuucugcuucaguguca

SEQ ID NO: 277 - RNA, 21 nt, Artificial Sequence
  Synthetic construct
uucugaagguuuauugagacc

SEQ ID NO: 278 - RNA, 21 nt, Artificial Sequence
  Synthetic construct
aggacagggagucaccugccc

SEQ ID NO: 279 - RNA, 21 nt, Artificial Sequence
  Synthetic construct
acaagauggaccacaaaggcc

SEQ ID NO: 280 - RNA, 21 nt, Artificial Sequence
  Synthetic construct
agagguccuggucccggucga

SEQ ID NO: 281 - RNA, 21 nt, Artificial Sequence
  Synthetic construct
agcugaguaugauagugaggu

SEQ ID NO: 282 - RNA, 21 nt, Artificial Sequence
  Synthetic construct
ucccuacccacucccagcccu

SEQ ID NO: 283 - RNA, 21 nt, Artificial Sequence
  Synthetic construct
aggcuccugaggagagagcug

SEQ ID NO: 284 - RNA, 21 nt, Artificial Sequence
  Synthetic construct
agaccauggguguccagggga

SEQ ID NO: 285 - RNA, 21 nt, Artificial Sequence
  Synthetic construct
guccacucgcagcucauacuu

SEQ ID NO: 286 - RNA, 21 nt, Artificial Sequence
  Synthetic construct
auugagaccuucagucccuac

SEQ ID NO: 287 - RNA, 21 nt, Artificial Sequence
  Synthetic construct
augaggccugugaaauacaag

SEQ ID NO: 288 - RNA, 21 nt, Artificial Sequence
  Synthetic construct
ucacagaagacgggcacaggc

SEQ ID NO: 289 - RNA, 21 nt, Artificial Sequence
  Synthetic construct
agauuguccucugcucccuca

SEQ ID NO: 290 - RNA, 21 nt, Artificial Sequence
  Synthetic construct
agaccuucagucccuacccac

SEQ ID NO: 291 - RNA, 21 nt, Artificial Sequence
  Synthetic construct
cuguucacacugcacugcuca

SEQ ID NO: 292 - RNA, 21 nt, Artificial Sequence
  Synthetic construct
guaggacaccaucagcagggg

SEQ ID NO: 293 - RNA, 21 nt, Artificial Sequence
  Synthetic construct
guguaacuucagguguagggg

SEQ ID NO: 294 - RNA, 21 nt, Artificial Sequence
  Synthetic construct
gagaccauggguguccagggg

SEQ ID NO: 295 - RNA, 21 nt, Artificial Sequence
  Synthetic construct
caacucauucucauggagccc

SEQ ID NO: 296 - RNA, 21 nt, Artificial Sequence
  Synthetic construct
cugacugguagcccugggcau

SEQ ID NO: 297 - RNA, 21 nt, Artificial Sequence
  Synthetic construct
ggaagaaacuuacugagccau

SEQ ID NO: 298 - RNA, 21 nt, Artificial Sequence
  Synthetic construct
cggaagaaacuuacugagcca

SEQ ID NO: 299 - RNA, 21 nt, Artificial Sequence
  Synthetic construct
cugucaguucugcucagagug

SEQ ID NO: 300 - RNA, 21 nt, Artificial Sequence
  Synthetic construct
cccagcuuguagucauuccag

SEQ ID NO: 301 - RNA, 21 nt, Artificial Sequence
  Synthetic construct
aagcccuuccacugggcccag

SEQ ID NO: 302 - RNA, 21 nt, Artificial Sequence
  Synthetic construct
guacacgccgucugacuggua

SEQ ID NO: 303 - RNA, 21 nt, Artificial Sequence
  Synthetic construct
gcuaaaccucucaacacccag

SEQ ID NO: 304 - RNA, 21 nt, Artificial Sequence
  Synthetic construct
agaagcagcagcagcggcagg

SEQ ID NO: 305 - RNA, 21 nt, Artificial Sequence
  Synthetic construct
ucagugucaggaggugcaugu

SEQ ID NO: 306 - RNA, 21 nt, Artificial Sequence
  Synthetic construct
agagaagcagcagcagcggca

SEQ ID NO: 307 - RNA, 21 nt, Artificial Sequence
  Synthetic construct
ugacugguagcccugggcaua

SEQ ID NO: 308 - RNA, 21 nt, Artificial Sequence
  Synthetic construct
cugcuucagugucaggaggug

SEQ ID NO: 309 - RNA, 21 nt, Artificial Sequence
  Synthetic construct
cacgguacucaccacagggga

SEQ ID NO: 310 - RNA, 21 nt, Artificial Sequence
  Synthetic construct
cucgguggucaugucacagaa

SEQ ID NO: 311 - RNA, 21 nt, Artificial Sequence
  Synthetic construct
aaggaguuggugcucgggaau

SEQ ID NO: 312 - RNA, 21 nt, Artificial Sequence
  Synthetic construct
gaguaugauagugaggugggc

SEQ ID NO: 313 - RNA, 21 nt, Artificial Sequence
  Synthetic construct
ggaaucagcagaagcaugcau

SEQ ID NO: 314 - RNA, 21 nt, Artificial Sequence
  Synthetic construct
cuagaaccaugugccucucgg

SEQ ID NO: 315 - RNA, 21 nt, Artificial Sequence
  Synthetic construct
cucgcagcucauacuucugcu

SEQ ID NO: 316 - RNA, 21 nt, Artificial Sequence
  Synthetic construct
ugcuucagugucaggaggugc

SEQ ID NO: 317 - RNA, 21 nt, Artificial Sequence
  Synthetic construct
uccuccaaguccacucgcagc

SEQ ID NO: 318 - RNA, 21 nt, Artificial Sequence
  Synthetic construct
aggagugccuucaugcuguca

SEQ ID NO: 319 - RNA, 21 nt, Artificial Sequence
  Synthetic construct
guccuccaaguccacucgcag

SEQ ID NO: 320 - RNA, 21 nt, Artificial Sequence
  Synthetic construct
acacugcacugcucagcuuag

SEQ ID NO: 321 - RNA, 21 nt, Artificial Sequence
  Synthetic construct
gaguaguagaagcccuuccac

SEQ ID NO: 322 - RNA, 21 nt, Artificial Sequence
  Synthetic construct
guagucauuccagccgcggaa

SEQ ID NO: 323 - RNA, 21 nt, Artificial Sequence
  Synthetic construct
cugcagagauuguccucugcu

SEQ ID NO: 324 - RNA, 21 nt, Artificial Sequence
  Synthetic construct
augggcccuguucacacugca

SEQ ID NO: 325 - RNA, 21 nt, Artificial Sequence
  Synthetic construct
auaggccguguuguucucaaa

SEQ ID NO: 326 - RNA, 21 nt, Artificial Sequence
  Synthetic construct
augggacaugguuugagagca

SEQ ID NO: 327 - RNA, 21 nt, Artificial Sequence
  Synthetic construct
gagggaguaguagaagcccuu

SEQ ID NO: 328 - RNA, 21 nt, Artificial Sequence
  Synthetic construct
gacagguuggaggcaacucau

SEQ ID NO: 329 - RNA, 21 nt, Artificial Sequence
  Synthetic construct
ccucauaugcaugccuaccuu

SEQ ID NO: 330 - RNA, 21 nt, Artificial Sequence
  Synthetic construct
aaucagcagaagcaugcauca

SEQ ID NO: 331 - RNA, 21 nt, Artificial Sequence
  Synthetic construct
ccaggcuagaaccaugugccu

SEQ ID NO: 332 - RNA, 21 nt, Artificial Sequence
  Synthetic construct
ugcacaaagagguccuggucc

SEQ ID NO: 333 - RNA, 21 nt, Artificial Sequence
  Synthetic construct
cguggagagaagcagcagcag

SEQ ID NO: 334 - RNA, 21 nt, Artificial Sequence
  Synthetic construct
cugcaccugacuccaggugua

SEQ ID NO: 335 - RNA, 21 nt, Artificial Sequence
  Synthetic construct
cuccaaguccacucgcagcuc

SEQ ID NO: 336 - RNA, 21 nt, Artificial Sequence
  Synthetic construct
aguaguagaagcccuuccacu

SEQ ID NO: 337 - RNA, 21 nt, Artificial Sequence
  Synthetic construct
ucagugcguuugagggaguag

SEQ ID NO: 338 - RNA, 21 nt, Artificial Sequence
  Synthetic construct
gguaggacagggagucaccug

SEQ ID NO: 339 - RNA, 21 nt, Artificial Sequence
  Synthetic construct
caggguggugugcgguagcug

SEQ ID NO: 340 - RNA, 21 nt, Artificial Sequence
  Synthetic construct
agacgggcacaggcacacugg

SEQ ID NO: 341 - RNA, 21 nt, Artificial Sequence
  Synthetic construct
cacagugaggaagcaggacaa

SEQ ID NO: 342 - RNA, 21 nt, Artificial Sequence
  Synthetic construct
cuucaugcugucaguucugcu

SEQ ID NO: 343 - RNA, 21 nt, Artificial Sequence
  Synthetic construct
ggagagaagcagcagcagcgg

SEQ ID NO: 344 - RNA, 21 nt, Artificial Sequence
  Synthetic construct
ugagguacacgccgucugacu

SEQ ID NO: 345 - RNA, 21 nt, Artificial Sequence
  Synthetic construct
cuccugaggagagagcugcgc

SEQ ID NO: 346 - RNA, 21 nt, Artificial Sequence
  Synthetic construct
aucuccucggaucccggagac

SEQ ID NO: 347 - RNA, 21 nt, Artificial Sequence
  Synthetic construct
ugagaccuucagucccuaccc

SEQ ID NO: 348 - RNA, 21 nt, Artificial Sequence
  Synthetic construct
uucugggcucgucacauccag

SEQ ID NO: 349 - RNA, 21 nt, Artificial Sequence
  Synthetic construct
ugauguugaugaacacagcug

SEQ ID NO: 350 - RNA, 21 nt, Artificial Sequence
  Synthetic construct
auguugaugaacacagcuguu

SEQ ID NO: 351 - RNA, 21 nt, Artificial Sequence
  Synthetic construct
uagacacaaacucugccugga

SEQ ID NO: 352 - RNA, 21 nt, Artificial Sequence
  Synthetic construct
uucuggaagaaguccuuguug

SEQ ID NO: 353 - RNA, 21 nt, Artificial Sequence
  Synthetic construct
uuguugcagagucccucgguu

SEQ ID NO: 354 - RNA, 21 nt, Artificial Sequence
  Synthetic construct
ucacauccaguccagcagcug

SEQ ID NO: 355 - RNA, 21 nt, Artificial Sequence
  Synthetic construct
aucuucuggaagaaguccuug

SEQ ID NO: 356 - RNA, 21 nt, Artificial Sequence
  Synthetic construct
uggaagaaguccuuguugcag

SEQ ID NO: 357 - RNA, 21 nt, Artificial Sequence
  Synthetic construct
uuuguaggcagugguucuggg

SEQ ID NO: 358 - RNA, 21 nt, Artificial Sequence
  Synthetic construct
uguugaugaacacagcuguuu

SEQ ID NO: 359 - RNA, 21 nt, Artificial Sequence
  Synthetic construct
aaucucuggacaccgaauggu

SEQ ID NO: 360 - RNA, 21 nt, Artificial Sequence
  Synthetic construct
uucugcugcuuccucaggccu

SEQ ID NO: 361 - RNA, 21 nt, Artificial Sequence
  Synthetic construct
uacagaaaucucuggacaccg

SEQ ID NO: 362 - RNA, 21 nt, Artificial Sequence
  Synthetic construct
ucgucacauccaguccagcag

SEQ ID NO: 363 - RNA, 21 nt, Artificial Sequence
  Synthetic construct
uugaugaacacagcuguuucc

SEQ ID NO: 364 - RNA, 21 nt, Artificial Sequence
  Synthetic construct
uugcagagucccucgguugca

SEQ ID NO: 365 - RNA, 21 nt, Artificial Sequence
  Synthetic construct
ugaugaacacagcuguuuccu

SEQ ID NO: 366 - RNA, 21 nt, Artificial Sequence
  Synthetic construct
ucaucuucuggaagaaguccu

SEQ ID NO: 367 - RNA, 21 nt, Artificial Sequence
  Synthetic construct
ucugcugcuuccucaggccug

SEQ ID NO: 368 - RNA, 21 nt, Artificial Sequence
  Synthetic construct
ucgguugcagguguuaaggag

SEQ ID NO: 369 - RNA, 21 nt, Artificial Sequence
  Synthetic construct
uuguaggcagugguucugggc

SEQ ID NO: 370 - RNA, 21 nt, Artificial Sequence
  Synthetic construct
uuccuucaucuucuggaagaa

SEQ ID NO: 371 - RNA, 21 nt, Artificial Sequence
  Synthetic construct
ucugccuggaauucugcugcu

SEQ ID NO: 372 - RNA, 21 nt, Artificial Sequence
  Synthetic construct
uucuucagggucaggagaggg

SEQ ID NO: 373 - RNA, 21 nt, Artificial Sequence
  Synthetic construct
uggaauucugcugcuuccuca

SEQ ID NO: 374 - RNA, 21 nt, Artificial Sequence
  Synthetic construct
agcuguuuccuucaucuucug

SEQ ID NO: 375 - RNA, 21 nt, Artificial Sequence
  Synthetic construct
uguuuccuucaucuucuggaa

SEQ ID NO: 376 - RNA, 21 nt, Artificial Sequence
  Synthetic construct
uucaucuucuggaagaagucc

SEQ ID NO: 377 - RNA, 21 nt, Artificial Sequence
  Synthetic construct
augaacacagcuguuuccuuc

SEQ ID NO: 378 - RNA, 21 nt, Artificial Sequence
  Synthetic construct
acagaaaucucuggacaccga

SEQ ID NO: 379 - RNA, 21 nt, Artificial Sequence
  Synthetic construct
uugcagguguuaaggagcagg

SEQ ID NO: 380 - RNA, 21 nt, Artificial Sequence
  Synthetic construct
ucucuggacaccgaaugguuu

SEQ ID NO: 381 - RNA, 21 nt, Artificial Sequence
  Synthetic construct
ucuucuggaagaaguccuugu

SEQ ID NO: 382 - RNA, 21 nt, Artificial Sequence
  Synthetic construct
ugguacaggucguccugguuu

SEQ ID NO: 383 - RNA, 21 nt, Artificial Sequence
  Synthetic construct
cugauguugaugaacacagcu

SEQ ID NO: 384 - RNA, 21 nt, Artificial Sequence
  Synthetic construct
guagacacaaacucugccugg

SEQ ID NO: 385 - RNA, 21 nt, Artificial Sequence
  Synthetic construct
augguuucagacgccgagcaa

SEQ ID NO: 386 - RNA, 21 nt, Artificial Sequence
  Synthetic construct
aacucugccuggaauucugcu

SEQ ID NO: 387 - RNA, 21 nt, Artificial Sequence
  Synthetic construct
aucucuggacaccgaaugguu

SEQ ID NO: 388 - RNA, 21 nt, Artificial Sequence
  Synthetic construct
uaggcagugguucugggcucg

SEQ ID NO: 389 - RNA, 21 nt, Artificial Sequence
  Synthetic construct
uguacagaaaucucuggacac

SEQ ID NO: 390 - RNA, 21 nt, Artificial Sequence
  Synthetic construct
uguugcagagucccucgguug

SEQ ID NO: 391 - RNA, 21 nt, Artificial Sequence
  Synthetic construct
ugcugauguugaugaacacag

SEQ ID NO: 392 - RNA, 21 nt, Artificial Sequence
  Synthetic construct
uucagggucaggagagggugg

SEQ ID NO: 393 - RNA, 21 nt, Artificial Sequence
  Synthetic construct
cuuguugcagagucccucggu

SEQ ID NO: 394 - RNA, 21 nt, Artificial Sequence
  Synthetic construct
acucugccuggaauucugcug

SEQ ID NO: 395 - RNA, 21 nt, Artificial Sequence
  Synthetic construct
cagaaaucucuggacaccgaa

SEQ ID NO: 396 - RNA, 21 nt, Artificial Sequence
  Synthetic construct
ugaaaucagauugggcagcca

SEQ ID NO: 397 - RNA, 21 nt, Artificial Sequence
  Synthetic construct
caucuucuggaagaaguccuu

SEQ ID NO: 398 - RNA, 21 nt, Artificial Sequence
  Synthetic construct
ugcagagucccucgguugcag

SEQ ID NO: 399 - RNA, 21 nt, Artificial Sequence
  Synthetic construct
aguccuuguugcagagucccu

SEQ ID NO: 400 - RNA, 21 nt, Artificial Sequence
  Synthetic construct
aaguccuuguugcagaguccc

SEQ ID NO: 401 - RNA, 21 nt, Artificial Sequence
  Synthetic construct
uccugguuuacgacgucgccc

SEQ ID NO: 402 - RNA, 21 nt, Artificial Sequence
  Synthetic construct
gauguugaugaacacagcugu

SEQ ID NO: 403 - RNA, 21 nt, Artificial Sequence
  Synthetic construct
aaaucucuggacaccgaaugg

SEQ ID NO: 404 - RNA, 21 nt, Artificial Sequence
  Synthetic construct
ucagggucaggagaggguggu

SEQ ID NO: 405 - RNA, 21 nt, Artificial Sequence
  Synthetic construct
uuuccuucaucuucuggaaga

SEQ ID NO: 406 - RNA, 21 nt, Artificial Sequence
  Synthetic construct
aagaaguccuuguugcagagu

SEQ ID NO: 407 - RNA, 21 nt, Artificial Sequence
  Synthetic construct
cugccuggaauucugcugcuu

SEQ ID NO: 408 - RNA, 21 nt, Artificial Sequence
  Synthetic construct
ucguccugguuuacgacgucg

SEQ ID NO: 409 - RNA, 21 nt, Artificial Sequence
  Synthetic construct
ugaacacagcuguuuccuuca

SEQ ID NO: 410 - RNA, 21 nt, Artificial Sequence
  Synthetic construct
gaacacagcuguuuccuucau

SEQ ID NO: 411 - RNA, 21 nt, Artificial Sequence
  Synthetic construct
caguccagcagcugcaaucuu

SEQ ID NO: 412 - RNA, 21 nt, Artificial Sequence
  Synthetic construct
acauccaguccagcagcugca

SEQ ID NO: 413 - RNA, 21 nt, Artificial Sequence
  Synthetic construct
uccuuguugcagagucccucg

SEQ ID NO: 414 - RNA, 21 nt, Artificial Sequence
  Synthetic construct
agacacaaacucugccuggaa

SEQ ID NO: 415 - RNA, 21 nt, Artificial Sequence
  Synthetic construct
aguccagcagcugcaaucuua

SEQ ID NO: 416 - RNA, 21 nt, Artificial Sequence
  Synthetic construct
aauucugcugcuuccucaggc

SEQ ID NO: 417 - RNA, 21 nt, Artificial Sequence
  Synthetic construct
ugcugcuuccucaggccuggg

SEQ ID NO: 418 - RNA, 21 nt, Artificial Sequence
  Synthetic construct
acagcuguuuccuucaucuuc

SEQ ID NO: 419 - RNA, 21 nt, Artificial Sequence
  Synthetic construct
cuucuggaagaaguccuuguu

SEQ ID NO: 420 - RNA, 21 nt, Artificial Sequence
  Synthetic construct
aaacucugccuggaauucugc

SEQ ID NO: 421 - RNA, 21 nt, Artificial Sequence
  Synthetic construct
cacagcuguuuccuucaucuu

SEQ ID NO: 422 - RNA, 21 nt, Artificial Sequence
  Synthetic construct
ucugggcucgucacauccagu

SEQ ID NO: 423 - RNA, 21 nt, Artificial Sequence
  Synthetic construct
auccaguccagcagcugcaau

SEQ ID NO: 424 - RNA, 21 nt, Artificial Sequence
  Synthetic construct
agcagcugcaaucuuaccacu

SEQ ID NO: 425 - RNA, 21 nt, Artificial Sequence
  Synthetic construct
ugcuuccucaggccugggcug

SEQ ID NO: 426 - RNA, 21 nt, Artificial Sequence
  Synthetic construct
uguaggcagugguucugggcu

SEQ ID NO: 427 - RNA, 21 nt, Artificial Sequence
  Synthetic construct
uacaggucguccugguuuacg

SEQ ID NO: 428 - RNA, 21 nt, Artificial Sequence
  Synthetic construct
cauccaguccagcagcugcaa

SEQ ID NO: 429 - RNA, 21 nt, Artificial Sequence
  Synthetic construct
agagucccucgguugcaggug

SEQ ID NO: 430 - RNA, 21 nt, Artificial Sequence
  Synthetic construct
ucuucagggucaggagagggu

SEQ ID NO: 431 - RNA, 21 nt, Artificial Sequence
  Synthetic construct
uccuucaucuucuggaagaag

SEQ ID NO: 432 - RNA, 21 nt, Artificial Sequence
  Synthetic construct
ccuuguugcagagucccucgg

SEQ ID NO: 433 - RNA, 21 nt, Artificial Sequence
  Synthetic construct
aacacagcuguuuccuucauc

SEQ ID NO: 434 - RNA, 21 nt, Artificial Sequence
  Synthetic construct
agucccucgguugcagguguu

SEQ ID NO: 435 - RNA, 21 nt, Artificial Sequence
  Synthetic construct
guugcagguguuaaggagcag

SEQ ID NO: 436 - RNA, 21 nt, Artificial Sequence
  Synthetic construct
ucuggaagaaguccuuguugc

SEQ ID NO: 437 - RNA, 21 nt, Artificial Sequence
  Synthetic construct
gaugaacacagcuguuuccuu

SEQ ID NO: 438 - RNA, 21 nt, Artificial Sequence
  Synthetic construct
cugguuuacgacgucgccccu

SEQ ID NO: 439 - RNA, 21 nt, Artificial Sequence
  Synthetic construct
cugguacaggucguccugguu

SEQ ID NO: 440 - RNA, 21 nt, Artificial Sequence
  Synthetic construct
cuguuuccuucaucuucugga

SEQ ID NO: 441 - RNA, 21 nt, Artificial Sequence
  Synthetic construct
aggccugguacaggucguccu

SEQ ID NO: 442 - RNA, 21 nt, Artificial Sequence
  Synthetic construct
acgacgaugaaaucagauugg

SEQ ID NO: 443 - RNA, 21 nt, Artificial Sequence
  Synthetic construct
auucugcugcuuccucaggcc

SEQ ID NO: 444 - RNA, 21 nt, Artificial Sequence
  Synthetic construct
cagcugcaaucuuaccacugg

SEQ ID NO: 445 - RNA, 21 nt, Artificial Sequence
  Synthetic construct
gcagcugcaaucuuaccacug

SEQ ID NO: 446 - RNA, 21 nt, Artificial Sequence
  Synthetic construct
aguucuucagggucaggagag

SEQ ID NO: 447 - RNA, 21 nt, Artificial Sequence
  Synthetic construct
accgaaugguuucagacgccg

SEQ ID NO: 448 - RNA, 21 nt, Artificial Sequence
  Synthetic construct
acaguucuucagggucaggag

SEQ ID NO: 449 - RNA, 21 nt, Artificial Sequence
  Synthetic construct
guccuuguugcagagucccuc

SEQ ID NO: 450 - RNA, 21 nt, Artificial Sequence
  Synthetic construct
gcuguuuccuucaucuucugg

SEQ ID NO: 451 - RNA, 21 nt, Artificial Sequence
  Synthetic construct
aaugguuucagacgccgagca

SEQ ID NO: 452 - RNA, 21 nt, Artificial Sequence
  Synthetic construct
ucuggacaccgaaugguuuca

SEQ ID NO: 453 - RNA, 21 nt, Artificial Sequence
  Synthetic construct
acaaacucugccuggaauucu

SEQ ID NO: 454 - RNA, 21 nt, Artificial Sequence
  Synthetic construct
ugguuuguaggcagugguucu

SEQ ID NO: 455 - RNA, 21 nt, Artificial Sequence
  Synthetic construct
caaacucugccuggaauucug

SEQ ID NO: 456 - RNA, 21 nt, Artificial Sequence
  Synthetic construct
cugcugauguugaugaacaca

SEQ ID NO: 457 - RNA, 21 nt, Artificial Sequence
  Synthetic construct
uauaaauacacaaacacugga

SEQ ID NO: 458 - RNA, 21 nt, Artificial Sequence
  Synthetic construct
uagaucaccauugaaauccau

SEQ ID NO: 459 - RNA, 21 nt, Artificial Sequence
  Synthetic construct
uagaauaagaagcaagaccaa

SEQ ID NO: 460 - RNA, 21 nt, Artificial Sequence
  Synthetic construct
uugcauugaagucugaaugua

SEQ ID NO: 461 - RNA, 21 nt, Artificial Sequence
  Synthetic construct
uugaccacuuacucugugcua

SEQ ID NO: 462 - RNA, 21 nt, Artificial Sequence
  Synthetic construct
uuaauguuuacaguaacucaa

SEQ ID NO: 463 - RNA, 21 nt, Artificial Sequence
  Synthetic construct
uauacaugauauaagguccag

SEQ ID NO: 464 - RNA, 21 nt, Artificial Sequence
  Synthetic construct
uuaucuuacgaggacagucau

SEQ ID NO: 465 - RNA, 21 nt, Artificial Sequence
  Synthetic construct
uuauaaauacacaaacacugg

SEQ ID NO: 466 - RNA, 21 nt, Artificial Sequence
  Synthetic construct
uuuaggucugucagcucccag

SEQ ID NO: 467 - RNA, 21 nt, Artificial Sequence
  Synthetic construct
uaucaaugcacugugauucuu

SEQ ID NO: 468 - RNA, 21 nt, Artificial Sequence
  Synthetic construct
uauugcugaaaucuuguagga

SEQ ID NO: 469 - RNA, 21 nt, Artificial Sequence
  Synthetic construct
auauugaccacuuacucugug

SEQ ID NO: 470 - RNA, 21 nt, Artificial Sequence
  Synthetic construct
uacuuguaguggucaaugcug

SEQ ID NO: 471 - RNA, 21 nt, Artificial Sequence
  Synthetic construct
uuacucugugcuaggcaccaa

SEQ ID NO: 472 - RNA, 21 nt, Artificial Sequence
  Synthetic construct
auuuauuugaauacuuuccaa

SEQ ID NO: 473 - RNA, 21 nt, Artificial Sequence
  Synthetic construct
uauggaaugacaauuagcugg

SEQ ID NO: 474 - RNA, 21 nt, Artificial Sequence
  Synthetic construct
uaggacuggaacccacugcuu

SEQ ID NO: 475 - RNA, 21 nt, Artificial Sequence
  Synthetic construct
uaauaugagcaaguaaaucuu

SEQ ID NO: 476 - RNA, 21 nt, Artificial Sequence
  Synthetic construct
uaagucuaauaagaucaucua

SEQ ID NO: 477 - RNA, 21 nt, Artificial Sequence
  Synthetic construct
uuuacuuagcacuacaauguc

SEQ ID NO: 478 - RNA, 21 nt, Artificial Sequence
  Synthetic construct
uuauagacuucuccaaguguu

SEQ ID NO: 479 - RNA, 21 nt, Artificial Sequence
  Synthetic construct
ugaccugcugugaugaagcug

SEQ ID NO: 480 - RNA, 21 nt, Artificial Sequence
  Synthetic construct
auacuuuccaauaauuaccau

SEQ ID NO: 481 - RNA, 21 nt, Artificial Sequence
  Synthetic construct
uugcgcuccgaccuaaaccaa

SEQ ID NO: 482 - RNA, 21 nt, Artificial Sequence
  Synthetic construct
uagacuuuaaacauucgacgc

SEQ ID NO: 483 - RNA, 21 nt, Artificial Sequence
  Synthetic construct
uuauuagcauugauaaacuuu

SEQ ID NO: 484 - RNA, 21 nt, Artificial Sequence
  Synthetic construct
uagaacacagaccacuaagaa

SEQ ID NO: 485 - RNA, 21 nt, Artificial Sequence
  Synthetic construct
uucuuuaguaugaccagagcg

SEQ ID NO: 486 - RNA, 21 nt, Artificial Sequence
  Synthetic construct
uagcacuacaauguccaagau

SEQ ID NO: 487 - RNA, 21 nt, Artificial Sequence
  Synthetic construct
uugaguauggucauauuguua

SEQ ID NO: 488 - RNA, 21 nt, Artificial Sequence
  Synthetic construct
uauagcaguaagcagaacaau

SEQ ID NO: 489 - RNA, 21 nt, Artificial Sequence
  Synthetic construct
ugacuguccaaccaccaucau

SEQ ID NO: 490 - RNA, 21 nt, Artificial Sequence
  Synthetic construct
aaucuuuaugucaaucaccaa

SEQ ID NO: 491 - RNA, 21 nt, Artificial Sequence
  Synthetic construct
auuauuagcauugauaaacuu

SEQ ID NO: 492 - RNA, 21 nt, Artificial Sequence
  Synthetic construct
uauuguagucuccaauaugaa

SEQ ID NO: 493 - RNA, 21 nt, Artificial Sequence
  Synthetic construct
uuaguaugaccagagcgucug

SEQ ID NO: 494 - RNA, 21 nt, Artificial Sequence
  Synthetic construct
auaaauacacaaacacuggag

SEQ ID NO: 495 - RNA, 21 nt, Artificial Sequence
  Synthetic construct
uugaauuaggaguuuaaggca

SEQ ID NO: 496 - RNA, 21 nt, Artificial Sequence
  Synthetic construct
uuguaggacuggaacccacug

SEQ ID NO: 497 - RNA, 21 nt, Artificial Sequence
  Synthetic construct
uaggaguuuaaggcaagucug

SEQ ID NO: 498 - RNA, 21 nt, Artificial Sequence
  Synthetic construct
uaucaggaauuagaucaccau

SEQ ID NO: 499 - RNA, 21 nt, Artificial Sequence
  Synthetic construct
ucgucaggaauaaaucugcug

SEQ ID NO: 500 - RNA, 21 nt, Artificial Sequence
  Synthetic construct
uugauuuaggucugucagcuc

SEQ ID NO: 501 - RNA, 21 nt, Artificial Sequence
  Synthetic construct
uauuuauuugaauacuuucca

SEQ ID NO: 502 - RNA, 21 nt, Artificial Sequence
  Synthetic construct
uauuucuauaauuagauguau

SEQ ID NO: 503 - RNA, 21 nt, Artificial Sequence
  Synthetic construct
uuguaguggucaaugcuggau

SEQ ID NO: 504 - RNA, 21 nt, Artificial Sequence
  Synthetic construct
uggaaugacaauuagcuggga

SEQ ID NO: 505 - RNA, 21 nt, Artificial Sequence
  Synthetic construct
uuguauauccuuuacuuagca

SEQ ID NO: 506 - RNA, 21 nt, Artificial Sequence
  Synthetic construct
auuauaaauacacaaacacug

SEQ ID NO: 507 - RNA, 21 nt, Artificial Sequence
  Synthetic construct
uauaguacugacagagaaguu

SEQ ID NO: 508 - RNA, 21 nt, Artificial Sequence
  Synthetic construct
uaaacauucgacgcgccucuu

SEQ ID NO: 509 - RNA, 21 nt, Artificial Sequence
  Synthetic construct
auuaauaaugacaacuaccac

SEQ ID NO: 510 - RNA, 21 nt, Artificial Sequence
  Synthetic construct
uuguuaucaaugcacugugau

SEQ ID NO: 511 - RNA, 21 nt, Artificial Sequence
  Synthetic construct
uaucaagucuauguauuucua

SEQ ID NO: 512 - RNA, 21 nt, Artificial Sequence
  Synthetic construct
uuggagagcuaaaugugcgga

SEQ ID NO: 513 - RNA, 21 nt, Artificial Sequence
  Synthetic construct
uuuccaauaauuaccauggga

SEQ ID NO: 514 - RNA, 21 nt, Artificial Sequence
  Synthetic construct
uauuguuaggaucuaauguuu

SEQ ID NO: 515 - RNA, 21 nt, Artificial Sequence
  Synthetic construct
uaguaugaccagagcgucugg

SEQ ID NO: 516 - RNA, 21 nt, Artificial Sequence
  Synthetic construct
uuaauaaugacaacuaccaca

SEQ ID NO: 517 - RNA, 21 nt, Artificial Sequence
  Synthetic construct
uaaggcaagucugucuuacug

SEQ ID NO: 518 - RNA, 21 nt, Artificial Sequence
  Synthetic construct
aagucuaauaagaucaucuaa

SEQ ID NO: 519 - RNA, 21 nt, Artificial Sequence
  Synthetic construct
uaagcagaacaauauuacuug

SEQ ID NO: 520 - RNA, 21 nt, Artificial Sequence
  Synthetic construct
uugaaagauaccuuuacuuug

SEQ ID NO: 521 - RNA, 21 nt, Artificial Sequence
  Synthetic construct
uacugugcuaccaagucagag

SEQ ID NO: 522 - RNA, 21 nt, Artificial Sequence
  Synthetic construct
uaagcacuucacauacaucau

SEQ ID NO: 523 - RNA, 21 nt, Artificial Sequence
  Synthetic construct
uuuggaaugauugcaguccac

SEQ ID NO: 524 - RNA, 21 nt, Artificial Sequence
  Synthetic construct
uauaauuagauguauaagucu

SEQ ID NO: 525 - RNA, 21 nt, Artificial Sequence
  Synthetic construct
uaauuagauguauaagucuaa

SEQ ID NO: 526 - RNA, 21 nt, Artificial Sequence
  Synthetic construct
uaaauuauagacuucuccaag

SEQ ID NO: 527 - RNA, 21 nt, Artificial Sequence
  Synthetic construct
auaugucagaaggacauccau

SEQ ID NO: 528 - RNA, 21 nt, Artificial Sequence
  Synthetic construct
ucuuuguauauccuuuacuua

SEQ ID NO: 529 - RNA, 21 nt, Artificial Sequence
  Synthetic construct
uuggagaguacuauaauuuuu

SEQ ID NO: 530 - RNA, 21 nt, Artificial Sequence
  Synthetic construct
uuaauucuuggagaguacuau

SEQ ID NO: 531 - RNA, 21 nt, Artificial Sequence
  Synthetic construct
auaauuagauguauaagucua

SEQ ID NO: 532 - RNA, 21 nt, Artificial Sequence
  Synthetic construct
uaagaagcaagaccaagucaa

SEQ ID NO: 533 - RNA, 21 nt, Artificial Sequence
  Synthetic construct
uagggcacauuaauucuugga

SEQ ID NO: 534 - RNA, 21 nt, Artificial Sequence
  Synthetic construct
ucugucuuacugugcuaccaa

SEQ ID NO: 535 - RNA, 21 nt, Artificial Sequence
  Synthetic construct
uucuuuguauauccuuuacuu

SEQ ID NO: 536 - RNA, 21 nt, Artificial Sequence
  Synthetic construct
uuauaaauaauauuuaaucuc

SEQ ID NO: 537 - RNA, 21 nt, Artificial Sequence
  Synthetic construct
uacaucaucccauuuaauguu

SEQ ID NO: 538 - RNA, 21 nt, Artificial Sequence
  Synthetic construct
uugcauuauuacaagggacgu

SEQ ID NO: 539 - RNA, 21 nt, Artificial Sequence
  Synthetic construct
uaauaaugacaacuaccacau

SEQ ID NO: 540 - RNA, 21 nt, Artificial Sequence
  Synthetic construct
uuugauuuaggucugucagcu

SEQ ID NO: 541 - RNA, 21 nt, Artificial Sequence
  Synthetic construct
uuucaguugguugcuguucau

SEQ ID NO: 542 - RNA, 21 nt, Artificial Sequence
  Synthetic construct
ugauucuugaaagauaccuuu

SEQ ID NO: 543 - RNA, 21 nt, Artificial Sequence
  Synthetic construct
uugguugcuguucauccacaa

SEQ ID NO: 544 - RNA, 21 nt, Artificial Sequence
  Synthetic construct
uugcauucccagaugcugccu

SEQ ID NO: 545 - RNA, 21 nt, Artificial Sequence
  Synthetic construct
uauauccuuuacuuagcacua

SEQ ID NO: 546 - RNA, 21 nt, Artificial Sequence
  Synthetic construct
aaugauugcaguccacucuug

SEQ ID NO: 547 - RNA, 21 nt, Artificial Sequence
  Synthetic construct
uuguauacaugauauaagguc

SEQ ID NO: 548 - RNA, 21 nt, Artificial Sequence
  Synthetic construct
uucaacuaaucaagugaacag

SEQ ID NO: 549 - RNA, 21 nt, Artificial Sequence
  Synthetic construct
uuaaaggcaagucacauagca

SEQ ID NO: 550 - RNA, 21 nt, Artificial Sequence
  Synthetic construct
uuacaguaacucaaguauuag

SEQ ID NO: 551 - RNA, 21 nt, Artificial Sequence
  Synthetic construct
aauaugagcaaguaaaucuuu

SEQ ID NO: 552 - RNA, 21 nt, Artificial Sequence
  Synthetic construct
aauaaugacaacuaccacaua

SEQ ID NO: 553 - RNA, 21 nt, Artificial Sequence
  Synthetic construct
augucgucaggaauaaaucug

SEQ ID NO: 554 - RNA, 21 nt, Artificial Sequence
  Synthetic construct
uaucuuacgaggacagucauu

SEQ ID NO: 555 - RNA, 21 nt, Artificial Sequence
  Synthetic construct
uuacuuagcacuacaaugucc

SEQ ID NO: 556 - RNA, 21 nt, Artificial Sequence
  Synthetic construct
auuuaggucugucagcuccca

SEQ ID NO: 557 - RNA, 21 nt, Artificial Sequence
  Synthetic construct
uuuauuugaauacuuuccaau

SEQ ID NO: 558 - RNA, 21 nt, Artificial Sequence
  Synthetic construct
ucgagggacauugugagggua

SEQ ID NO: 559 - RNA, 21 nt, Artificial Sequence
  Synthetic construct
uuccaucuucguaaaugucaa

SEQ ID NO: 560 - RNA, 21 nt, Artificial Sequence
  Synthetic construct
aagaauauuucuucaugccug

SEQ ID NO: 561 - RNA, 21 nt, Artificial Sequence
  Synthetic construct
aucuuguaggacuggaaccca

SEQ ID NO: 562 - RNA, 21 nt, Artificial Sequence
  Synthetic construct
uacuuagcacuacaaugucca

SEQ ID NO: 563 - RNA, 21 nt, Artificial Sequence
  Synthetic construct
uaauuggaauugguauuucag

SEQ ID NO: 564 - RNA, 21 nt, Artificial Sequence
  Synthetic construct
uuuaauguuuacaguaacuca

SEQ ID NO: 565 - RNA, 21 nt, Artificial Sequence
  Synthetic construct
uugcuguucauccacaaaugg

SEQ ID NO: 566 - RNA, 21 nt, Artificial Sequence
  Synthetic construct
ugaaugccuaaugacuccgug

SEQ ID NO: 567 - RNA, 21 nt, Artificial Sequence
  Synthetic construct
ucaaacuggaagguacuagug

SEQ ID NO: 568 - RNA, 21 nt, Artificial Sequence
  Synthetic construct
aacagcuccuaauucacucuu

SEQ ID NO: 569 - RNA, 21 nt, Artificial Sequence
  Synthetic construct
uccaauauaguacugacagag

SEQ ID NO: 570 - RNA, 21 nt, Artificial Sequence
  Synthetic construct
uucaagaaaucaaauguucuu

SEQ ID NO: 571 - RNA, 21 nt, Artificial Sequence
  Synthetic construct
uuaagaagacauguuaacaug

SEQ ID NO: 572 - RNA, 21 nt, Artificial Sequence
  Synthetic construct
uaaaggcaagucacauagcau

SEQ ID NO: 573 - RNA, 21 nt, Artificial Sequence
  Synthetic construct
uacacaaacacuggaguacau

SEQ ID NO: 574 - RNA, 21 nt, Artificial Sequence
  Synthetic construct
ugaauuaggaguuuaaggcaa

SEQ ID NO: 575 - RNA, 21 nt, Artificial Sequence
  Synthetic construct
aauuugauuuaggucugucag

SEQ ID NO: 576 - RNA, 21 nt, Artificial Sequence
  Synthetic construct
uuuacagagguuaaacaagag

SEQ ID NO: 577 - RNA, 21 nt, Artificial Sequence
  Synthetic construct
aagaacaauaacuuuaacaaa

SEQ ID NO: 578 - RNA, 21 nt, Artificial Sequence
  Synthetic construct
uaaauaauauuuaaucucccc

SEQ ID NO: 579 - RNA, 21 nt, Artificial Sequence
  Synthetic construct
auauuguuaggaucuaauguu

SEQ ID NO: 580 - RNA, 21 nt, Artificial Sequence
  Synthetic construct
uauuuauuaagaagacauguu

SEQ ID NO: 581 - RNA, 21 nt, Artificial Sequence
  Synthetic construct
uagauguauaagucuaauaag

SEQ ID NO: 582 - RNA, 21 nt, Artificial Sequence
  Synthetic construct
uaaguagaugguacucuuuug

SEQ ID NO: 583 - RNA, 21 nt, Artificial Sequence
  Synthetic construct
aacuaaucaagugaacagcca

SEQ ID NO: 584 - RNA, 21 nt, Artificial Sequence
  Synthetic construct
uacaugcaacacauuccacaa

SEQ ID NO: 585 - RNA, 21 nt, Artificial Sequence
  Synthetic construct
uuugcauugaagucugaaugu

SEQ ID NO: 586 - RNA, 21 nt, Artificial Sequence
  Synthetic construct
uuugagaauagaaaugugauu

SEQ ID NO: 587 - RNA, 21 nt, Artificial Sequence
  Synthetic construct
uaagugguugaauuaggaguu

SEQ ID NO: 588 - RNA, 21 nt, Artificial Sequence
  Synthetic construct
uuuauuaagaagacauguuaa

SEQ ID NO: 589 - RNA, 21 nt, Artificial Sequence
  Synthetic construct
uuggaauugguauuucaguug

SEQ ID NO: 590 - RNA, 21 nt, Artificial Sequence
  Synthetic construct
aucaagucuauguauuucuau

SEQ ID NO: 591 - RNA, 21 nt, Artificial Sequence
  Synthetic construct
uucauuaucacaugauaagga

SEQ ID NO: 592 - RNA, 21 nt, Artificial Sequence
  Synthetic construct
aacaaugacuuuguaaguggu

SEQ ID NO: 593 - RNA, 21 nt, Artificial Sequence
  Synthetic construct
auugaguauggucauauuguu

SEQ ID NO: 594 - RNA, 21 nt, Artificial Sequence
  Synthetic construct
uacaguuguauacaugauaua

SEQ ID NO: 595 - RNA, 21 nt, Artificial Sequence
  Synthetic construct
uaccaagucagaguacccgau

SEQ ID NO: 596 - RNA, 21 nt, Artificial Sequence
  Synthetic construct
uauaagucuaauaagaucauc

SEQ ID NO: 597 - RNA, 21 nt, Artificial Sequence
  Synthetic construct
ugguauuucaguugguugcug

SEQ ID NO: 598 - RNA, 21 nt, Artificial Sequence
  Synthetic construct
aagcagaacaauauuacuugg

SEQ ID NO: 599 - RNA, 21 nt, Artificial Sequence
  Synthetic construct
aaauacacaaacacuggagua

SEQ ID NO: 600 - RNA, 21 nt, Artificial Sequence
  Synthetic construct
ugcauuauuacaagggacguu

SEQ ID NO: 601 - RNA, 21 nt, Artificial Sequence
  Synthetic construct
uuguaagugguugaauuagga

SEQ ID NO: 602 - RNA, 21 nt, Artificial Sequence
  Synthetic construct
uacuugguguaagauacaguu

SEQ ID NO: 603 - RNA, 21 nt, Artificial Sequence
  Synthetic construct
uuaauuugauuuaggucuguc

SEQ ID NO: 604 - RNA, 21 nt, Artificial Sequence
  Synthetic construct
aauaagauuauaaauacacaa

SEQ ID NO: 605 - RNA, 21 nt, Artificial Sequence
  Synthetic construct
uuggauucauuugugauacca

SEQ ID NO: 606 - RNA, 21 nt, Artificial Sequence
  Synthetic construct
uaagcaucugcuucaaaguua

SEQ ID NO: 607 - RNA, 21 nt, Artificial Sequence
  Synthetic construct
agacuuuaaacauucgacgcg

SEQ ID NO: 608 - RNA, 21 nt, Artificial Sequence
  Synthetic construct
acauauugaccacuuacucug

SEQ ID NO: 609 - RNA, 21 nt, Artificial Sequence
  Synthetic construct
ugacagagaaguuuccaucca

SEQ ID NO: 610 - RNA, 21 nt, Artificial Sequence
  Synthetic construct
uaggucugucagcucccagua

SEQ ID NO: 611 - RNA, 21 nt, Artificial Sequence
  Synthetic construct
aucuacaguuguauacaugau

SEQ ID NO: 612 - RNA, 21 nt, Artificial Sequence
  Synthetic construct
uauguauuucuauaauuagau

SEQ ID NO: 613 - RNA, 21 nt, Artificial Sequence
  Synthetic construct
accacuaagaacaauaacuuu

SEQ ID NO: 614 - RNA, 21 nt, Artificial Sequence
  Synthetic construct
ugugaugaagcugaaugccua

SEQ ID NO: 615 - RNA, 21 nt, Artificial Sequence
  Synthetic construct
ucagauacccauuugcaucua

SEQ ID NO: 616 - RNA, 21 nt, Artificial Sequence
  Synthetic construct
auuagcauugauaaacuuuuu

SEQ ID NO: 617 - RNA, 21 nt, Artificial Sequence
  Synthetic construct
uaacagcuccuaauucacucu

SEQ ID NO: 618 - RNA, 21 nt, Artificial Sequence
  Synthetic construct
auaaugacaacuaccacauau

SEQ ID NO: 619 - RNA, 21 nt, Artificial Sequence
  Synthetic construct
uauuaauaaugacaacuacca

SEQ ID NO: 620 - RNA, 21 nt, Artificial Sequence
  Synthetic construct
uauuugaauacuuuccaauaa

SEQ ID NO: 621 - RNA, 21 nt, Artificial Sequence
  Synthetic construct
uaaaugcaugagaauguggaa

SEQ ID NO: 622 - RNA, 21 nt, Artificial Sequence
  Synthetic construct
uaauguuuacaguaacucaag

SEQ ID NO: 623 - RNA, 21 nt, Artificial Sequence
  Synthetic construct
uacagcacuacagaauagaga

SEQ ID NO: 624 - RNA, 21 nt, Artificial Sequence
  Synthetic construct
uugguguaagauacaguuugg

SEQ ID NO: 625 - RNA, 21 nt, Artificial Sequence
  Synthetic construct
aaugugauugaagauuugcau

SEQ ID NO: 626 - RNA, 21 nt, Artificial Sequence
  Synthetic construct
uguaagugguugaauuaggag

SEQ ID NO: 627 - RNA, 21 nt, Artificial Sequence
  Synthetic construct
auuacuugguguaagauacag

SEQ ID NO: 628 - RNA, 21 nt, Artificial Sequence
  Synthetic construct
uuuacaguaacucaaguauua

SEQ ID NO: 629 - RNA, 21 nt, Artificial Sequence
  Synthetic construct
ucguaaaugucaaagaaggug

SEQ ID NO: 630 - RNA, 21 nt, Artificial Sequence
  Synthetic construct
uugguauuucaguugguugcu

SEQ ID NO: 631 - RNA, 21 nt, Artificial Sequence
  Synthetic construct
acacuuguuaucaaugcacug

SEQ ID NO: 632 - RNA, 21 nt, Artificial Sequence
  Synthetic construct
uucacauacaucaucccauuu

SEQ ID NO: 633 - RNA, 21 nt, Artificial Sequence
  Synthetic construct
aacuggaagguacuaguggug

SEQ ID NO: 634 - RNA, 21 nt, Artificial Sequence
  Synthetic construct
uaggaucuaauguuugauuuu

SEQ ID NO: 635 - RNA, 21 nt, Artificial Sequence
  Synthetic construct
ucuuuaguaugaccagagcgu

SEQ ID NO: 636 - RNA, 21 nt, Artificial Sequence
  Synthetic construct
uuauguaauauuaaaggcaag

SEQ ID NO: 637 - RNA, 21 nt, Artificial Sequence
  Synthetic construct
uacugacagagaaguuuccau

SEQ ID NO: 638 - RNA, 21 nt, Artificial Sequence
  Synthetic construct
augacuuuguaagugguugaa

SEQ ID NO: 639 - RNA, 21 nt, Artificial Sequence
  Synthetic construct
auuacaagggacguucuccag

SEQ ID NO: 640 - RNA, 21 nt, Artificial Sequence
  Synthetic construct
ucugugcuaggcaccaagcua

SEQ ID NO: 641 - RNA, 21 nt, Artificial Sequence
  Synthetic construct
uacccauuugcaucuacaguu

SEQ ID NO: 642 - RNA, 21 nt, Artificial Sequence
  Synthetic construct
ugcaucuacaguuguauacau

SEQ ID NO: 643 - RNA, 21 nt, Artificial Sequence
  Synthetic construct
ucauucuuuguauauccuuua

SEQ ID NO: 644 - RNA, 21 nt, Artificial Sequence
  Synthetic construct
uuagaucaccauugaaaucca

SEQ ID NO: 645 - RNA, 21 nt, Artificial Sequence
  Synthetic construct
uugagaauagaaaugugauug

SEQ ID NO: 646 - RNA, 21 nt, Artificial Sequence
  Synthetic construct
uaugucagaaggacauccauu

SEQ ID NO: 647 - RNA, 21 nt, Artificial Sequence
  Synthetic construct
uaagaacaauaacuuuaacaa

SEQ ID NO: 648 - RNA, 21 nt, Artificial Sequence
  Synthetic construct
uugugacauauucaaaccaua

SEQ ID NO: 649 - RNA, 21 nt, Artificial Sequence
  Synthetic construct
uuuaguaugaccagagcgucu

SEQ ID NO: 650 - RNA, 21 nt, Artificial Sequence
  Synthetic construct
uuguaugguaguuggagagcu

SEQ ID NO: 651 - RNA, 21 nt, Artificial Sequence
  Synthetic construct
uugcaguccacucuuguuuuc

SEQ ID NO: 652 - RNA, 21 nt, Artificial Sequence
  Synthetic construct
uauuagcauugauaaacuuuu

SEQ ID NO: 653 - RNA, 21 nt, Artificial Sequence
  Synthetic construct
uagucuccaauaugaagggua

SEQ ID NO: 654 - RNA, 21 nt, Artificial Sequence
  Synthetic construct
uuucaaacuggaagguacuag

SEQ ID NO: 655 - RNA, 21 nt, Artificial Sequence
  Synthetic construct
aauuauagacuucuccaagug

SEQ ID NO: 656 - RNA, 21 nt, Artificial Sequence
  Synthetic construct
auaagcaucugcuucaaaguu

SEQ ID NO: 657 - RNA, 21 nt, Artificial Sequence
  Synthetic construct
aaacuggaagguacuaguggu

SEQ ID NO: 658 - RNA, 21 nt, Artificial Sequence
  Synthetic construct
augacaacuaccacauauuga

SEQ ID NO: 659 - RNA, 21 nt, Artificial Sequence
  Synthetic construct
uguauuucuauaauuagaugu

SEQ ID NO: 660 - RNA, 21 nt, Artificial Sequence
  Synthetic construct
aagucugcaaaugcugacugu

SEQ ID NO: 661 - RNA, 21 nt, Artificial Sequence
  Synthetic construct
ucucuaucaucugcuuucuuu

SEQ ID NO: 662 - RNA, 21 nt, Artificial Sequence
  Synthetic construct
acaacuaccacauauugacca

SEQ ID NO: 663 - RNA, 21 nt, Artificial Sequence
  Synthetic construct
uauucaaaccauauuuauuug

SEQ ID NO: 664 - RNA, 21 nt, Artificial Sequence
  Synthetic construct
uucguaaaugucaaagaaggu

SEQ ID NO: 665 - RNA, 21 nt, Artificial Sequence
  Synthetic construct
auugcugaaaucuuguaggac

SEQ ID NO: 666 - RNA, 21 nt, Artificial Sequence
  Synthetic construct
uucgagggacauugugagggu

SEQ ID NO: 667 - RNA, 21 nt, Artificial Sequence
  Synthetic construct
agucauuagaacacagaccac

SEQ ID NO: 668 - RNA, 21 nt, Artificial Sequence
  Synthetic construct
uagacuucuccaaguguuuga

SEQ ID NO: 669 - RNA, 21 nt, Artificial Sequence
  Synthetic construct
uuauugcugaaaucuuguagg

SEQ ID NO: 670 - RNA, 21 nt, Artificial Sequence
  Synthetic construct
acuaaucaagugaacagccau

SEQ ID NO: 671 - RNA, 21 nt, Artificial Sequence
  Synthetic construct
uugaagucugaauguaaauua

SEQ ID NO: 672 - RNA, 21 nt, Artificial Sequence
  Synthetic construct
augagaauguggaauucgcau

SEQ ID NO: 673 - RNA, 21 nt, Artificial Sequence
  Synthetic construct
uguaaauuauagacuucucca

SEQ ID NO: 674 - RNA, 21 nt, Artificial Sequence
  Synthetic construct
uauagacuucuccaaguguuu

SEQ ID NO: 675 - RNA, 21 nt, Artificial Sequence
  Synthetic construct
uuaggaucuaauguuugauuu

SEQ ID NO: 676 - RNA, 21 nt, Artificial Sequence
  Synthetic construct
ucuuguaggacuggaacccac

SEQ ID NO: 677 - RNA, 21 nt, Artificial Sequence
  Synthetic construct
ugcugacuguccaaccaccau

SEQ ID NO: 678 - RNA, 21 nt, Artificial Sequence
  Synthetic construct
uuagaauaagaagcaagacca

SEQ ID NO: 679 - RNA, 21 nt, Artificial Sequence
  Synthetic construct
uguuaggaucuaauguuugau

SEQ ID NO: 680 - RNA, 21 nt, Artificial Sequence
  Synthetic construct
uggucauauuguuaggaucua

SEQ ID NO: 681 - RNA, 21 nt, Artificial Sequence
  Synthetic construct
uugaauacuuuccaauaauua

SEQ ID NO: 682 - RNA, 21 nt, Artificial Sequence
  Synthetic construct
ugauugcaguccacucuuguu

SEQ ID NO: 683 - RNA, 21 nt, Artificial Sequence
  Synthetic construct
uuaaacauucgacgcgccucu

SEQ ID NO: 684 - RNA, 21 nt, Artificial Sequence
  Synthetic construct
auguuuacaguaacucaagua

SEQ ID NO: 685 - RNA, 21 nt, Artificial Sequence
  Synthetic construct
uuacugugcuaccaagucaga

SEQ ID NO: 686 - RNA, 21 nt, Artificial Sequence
  Synthetic construct
uucuucauuaucacaugauaa

SEQ ID NO: 687 - RNA, 21 nt, Artificial Sequence
  Synthetic construct
ugaauguaaauuauagacuuc

SEQ ID NO: 688 - RNA, 21 nt, Artificial Sequence
  Synthetic construct
uagcugggaauuuggaaugau

SEQ ID NO: 689 - RNA, 21 nt, Artificial Sequence
  Synthetic construct
uaggcaucacauguccauuug

SEQ ID NO: 690 - RNA, 21 nt, Artificial Sequence
  Synthetic construct
ugauauaagguccagguugau

SEQ ID NO: 691 - RNA, 21 nt, Artificial Sequence
  Synthetic construct
ucuauguauuucuauaauuag

SEQ ID NO: 692 - RNA, 21 nt, Artificial Sequence
  Synthetic construct
ugcaacacauuccacaaagga

SEQ ID NO: 693 - RNA, 21 nt, Artificial Sequence
  Synthetic construct
uuuaaacauucgacgcgccuc

SEQ ID NO: 694 - RNA, 21 nt, Artificial Sequence
  Synthetic construct
uugaagauuugcauucccaga

SEQ ID NO: 695 - RNA, 21 nt, Artificial Sequence
  Synthetic construct
ugugauucuugaaagauaccu

SEQ ID NO: 696 - RNA, 21 nt, Artificial Sequence
  Synthetic construct
guaaauuauagacuucuccaa

SEQ ID NO: 697 - RNA, 21 nt, Artificial Sequence
  Synthetic construct
aaaugcugacuguccaaccac

SEQ ID NO: 698 - RNA, 21 nt, Artificial Sequence
  Synthetic construct
ucuugaaagauaccuuuacuu

SEQ ID NO: 699 - RNA, 21 nt, Artificial Sequence
  Synthetic construct
uacuuuccaauaauuaccaug

SEQ ID NO: 700 - RNA, 21 nt, Artificial Sequence
  Synthetic construct
auugaagauuugcauucccag

SEQ ID NO: 701 - RNA, 21 nt, Artificial Sequence
  Synthetic construct
ugcugaaaucuuguaggacug

SEQ ID NO: 702 - RNA, 21 nt, Artificial Sequence
  Synthetic construct
auucccuccuaauaguaucug

SEQ ID NO: 703 - RNA, 21 nt, Artificial Sequence
  Synthetic construct
uguagucuccaauaugaaggg

SEQ ID NO: 704 - RNA, 21 nt, Artificial Sequence
  Synthetic construct
uguuucaacuaaucaagugaa

SEQ ID NO: 705 - RNA, 21 nt, Artificial Sequence
  Synthetic construct
uauaauuugcaucauuagaau

SEQ ID NO: 706 - RNA, 21 nt, Artificial Sequence
  Synthetic construct
auuguuaggaucuaauguuug

SEQ ID NO: 707 - RNA, 21 nt, Artificial Sequence
  Synthetic construct
auauccuuuacuuagcacuac

SEQ ID NO: 708 - RNA, 21 nt, Artificial Sequence
  Synthetic construct
uguaugguaguuggagagcua

SEQ ID NO: 709 - RNA, 21 nt, Artificial Sequence
  Synthetic construct
aacaugcuuagauacaaagua

SEQ ID NO: 710 - RNA, 21 nt, Artificial Sequence
  Synthetic construct
auguucuucauuaucacauga

SEQ ID NO: 711 - RNA, 21 nt, Artificial Sequence
  Synthetic construct
uacccgaucacuauauuguau

SEQ ID NO: 712 - RNA, 21 nt, Artificial Sequence
  Synthetic construct
uguucuucauuaucacaugau

SEQ ID NO: 713 - RNA, 21 nt, Artificial Sequence
  Synthetic construct
uuagcugggaauuuggaauga

SEQ ID NO: 714 - RNA, 21 nt, Artificial Sequence
  Synthetic construct
uaaauacacaaacacuggagu

SEQ ID NO: 715 - RNA, 21 nt, Artificial Sequence
  Synthetic construct
aggaauuagaucaccauugaa

SEQ ID NO: 716 - RNA, 21 nt, Artificial Sequence
  Synthetic construct
uucccuccuaauaguaucugu

SEQ ID NO: 717 - RNA, 21 nt, Artificial Sequence
  Synthetic construct
uuacuugguguaagauacagu

SEQ ID NO: 718 - RNA, 21 nt, Artificial Sequence
  Synthetic construct
aaagauaccuuuacuuugggu

SEQ ID NO: 719 - RNA, 21 nt, Artificial Sequence
  Synthetic construct
uuagauguauaagucuaauaa

SEQ ID NO: 720 - RNA, 21 nt, Artificial Sequence
  Synthetic construct
acacauuccacaaaggaacaa

SEQ ID NO: 721 - RNA, 21 nt, Artificial Sequence
  Synthetic construct
ucuacaguuguauacaugaua

SEQ ID NO: 722 - RNA, 21 nt, Artificial Sequence
  Synthetic construct
uguauauccuuuacuuagcac

SEQ ID NO: 723 - RNA, 21 nt, Artificial Sequence
  Synthetic construct
uuguuaggaucuaauguuuga

SEQ ID NO: 724 - RNA, 21 nt, Artificial Sequence
  Synthetic construct
ucugcaaaugcugacugucca

SEQ ID NO: 725 - RNA, 21 nt, Artificial Sequence
  Synthetic construct
uaccaacguagagauggucaa

SEQ ID NO: 726 - RNA, 21 nt, Artificial Sequence
  Synthetic construct
uaaaccaagcacguuguaugg

SEQ ID NO: 727 - RNA, 21 nt, Artificial Sequence
  Synthetic construct
aagaaaucaaauguucuucau

SEQ ID NO: 728 - RNA, 21 nt, Artificial Sequence
  Synthetic construct
ucacaugauaaggauaaguuu

SEQ ID NO: 729 - RNA, 21 nt, Artificial Sequence
  Synthetic construct
ugaaaucuuguaggacuggaa

SEQ ID NO: 730 - RNA, 21 nt, Artificial Sequence
  Synthetic construct
ugucagaaggacauccauuug

SEQ ID NO: 731 - RNA, 21 nt, Artificial Sequence
  Synthetic construct
acuuagcacuacaauguccaa

SEQ ID NO: 732 - RNA, 21 nt, Artificial Sequence
  Synthetic construct
aacuucgagggacauugugag

SEQ ID NO: 733 - RNA, 21 nt, Artificial Sequence
  Synthetic construct
auggaaugacaauuagcuggg

SEQ ID NO: 734 - RNA, 21 nt, Artificial Sequence
  Synthetic construct
auauuuauuaagaagacaugu

SEQ ID NO: 735 - RNA, 21 nt, Artificial Sequence
  Synthetic construct
uaccaugggauacaucauuua

SEQ ID NO: 736 - RNA, 21 nt, Artificial Sequence
  Synthetic construct
aucuucguaaaugucaaagaa

SEQ ID NO: 737 - RNA, 21 nt, Artificial Sequence
  Synthetic construct
ucuuacugugcuaccaaguca

SEQ ID NO: 738 - RNA, 21 nt, Artificial Sequence
  Synthetic construct
ucauuaucacaugauaaggau

SEQ ID NO: 739 - RNA, 21 nt, Artificial Sequence
  Synthetic construct
uaauuugauuuaggucuguca

SEQ ID NO: 740 - RNA, 21 nt, Artificial Sequence
  Synthetic construct
aguacaugcaacacauuccac

SEQ ID NO: 741 - RNA, 21 nt, Artificial Sequence
  Synthetic construct
aucauucuuuguauauccuuu

SEQ ID NO: 742 - RNA, 21 nt, Artificial Sequence
  Synthetic construct
aaauaauauuuaaucuccccu

SEQ ID NO: 743 - RNA, 21 nt, Artificial Sequence
  Synthetic construct
caagucugucuuacugugcua

SEQ ID NO: 744 - RNA, 21 nt, Artificial Sequence
  Synthetic construct
aaagucugcaaaugcugacug

SEQ ID NO: 745 - RNA, 21 nt, Artificial Sequence
  Synthetic construct
augauugcaguccacucuugu

SEQ ID NO: 746 - RNA, 21 nt, Artificial Sequence
  Synthetic construct
aaaccaagcacguuguauggu

SEQ ID NO: 747 - RNA, 21 nt, Artificial Sequence
  Synthetic construct
auaaauaauauuuaaucuccc

SEQ ID NO: 748 - RNA, 21 nt, Artificial Sequence
  Synthetic construct
uuugcaucauuagaauaagaa

SEQ ID NO: 749 - RNA, 21 nt, Artificial Sequence
  Synthetic construct
aacacagaccacuaagaacaa

SEQ ID NO: 750 - RNA, 21 nt, Artificial Sequence
  Synthetic construct
acaaugacuuuguaagugguu

SEQ ID NO: 751 - RNA, 21 nt, Artificial Sequence
  Synthetic construct
uucuauaauuagauguauaag

SEQ ID NO: 752 - RNA, 21 nt, Artificial Sequence
  Synthetic construct
auuuauuaagaagacauguua

SEQ ID NO: 753 - RNA, 21 nt, Artificial Sequence
  Synthetic construct
auugaaauccauaauuagugg

SEQ ID NO: 754 - RNA, 21 nt, Artificial Sequence
  Synthetic construct
auuauagacuucuccaagugu

SEQ ID NO: 755 - RNA, 21 nt, Artificial Sequence
  Synthetic construct
aaugacaacuaccacauauug

SEQ ID NO: 756 - RNA, 21 nt, Artificial Sequence
  Synthetic construct
aagugguugaauuaggaguuu

SEQ ID NO: 757 - RNA, 21 nt, Artificial Sequence
  Synthetic construct
auaguacugacagagaaguuu

SEQ ID NO: 758 - RNA, 21 nt, Artificial Sequence
  Synthetic construct
aaagaauauuucuucaugccu

SEQ ID NO: 759 - RNA, 21 nt, Artificial Sequence
  Synthetic construct
uccaucuccaucaaagucugc

SEQ ID NO: 760 - RNA, 21 nt, Artificial Sequence
  Synthetic construct
ugacauauucaaaccauauuu

SEQ ID NO: 761 - RNA, 21 nt, Artificial Sequence
  Synthetic construct
uagcaguaagcagaacaauau

SEQ ID NO: 762 - RNA, 21 nt, Artificial Sequence
  Synthetic construct
ugaccacuuacucugugcuag

SEQ ID NO: 763 - RNA, 21 nt, Artificial Sequence
  Synthetic construct
auaagguccagguugauucac

SEQ ID NO: 764 - RNA, 21 nt, Artificial Sequence
  Synthetic construct
uauaggcaucacauguccauu

SEQ ID NO: 765 - RNA, 21 nt, Artificial Sequence
  Synthetic construct
uguuugagaauagaaauguga

SEQ ID NO: 766 - RNA, 21 nt, Artificial Sequence
  Synthetic construct
auagacuucuccaaguguuug

SEQ ID NO: 767 - RNA, 21 nt, Artificial Sequence
  Synthetic construct
uguccaagauuccaucuucgu

SEQ ID NO: 768 - RNA, 21 nt, Artificial Sequence
  Synthetic construct
uucuaucaagucuauguauuu

SEQ ID NO: 769 - RNA, 21 nt, Artificial Sequence
  Synthetic construct
agaagacauguuaacaugcuu

SEQ ID NO: 770 - RNA, 21 nt, Artificial Sequence
  Synthetic construct
auguacagcacuacagaauag

SEQ ID NO: 771 - RNA, 21 nt, Artificial Sequence
  Synthetic construct
uaggcaccaagcuaagcacuu

SEQ ID NO: 772 - RNA, 21 nt, Artificial Sequence
  Synthetic construct
ucauuagaacacagaccacua

SEQ ID NO: 773 - RNA, 21 nt, Artificial Sequence
  Synthetic construct
ucauuuauaaauaauauuuaa

SEQ ID NO: 774 - RNA, 21 nt, Artificial Sequence
  Synthetic construct
agaaucuccaucauaaucccc

SEQ ID NO: 775 - RNA, 21 nt, Artificial Sequence
  Synthetic construct
uaauucuuggagaguacuaua

SEQ ID NO: 776 - RNA, 21 nt, Artificial Sequence
  Synthetic construct
aucucagugaacuauaaagaa

SEQ ID NO: 777 - RNA, 21 nt, Artificial Sequence
  Synthetic construct
auccuuuacuuagcacuacaa

SEQ ID NO: 778 - RNA, 21 nt, Artificial Sequence
  Synthetic construct
auguccauuugcauacuagaa

SEQ ID NO: 779 - RNA, 21 nt, Artificial Sequence
  Synthetic construct
uaaaucuuuaugucaaucacc

SEQ ID NO: 780 - RNA, 21 nt, Artificial Sequence
  Synthetic construct
uccaucuucguaaaugucaaa

SEQ ID NO: 781 - RNA, 21 nt, Artificial Sequence
  Synthetic construct
uuuaaggcaagucugucuuac

SEQ ID NO: 782 - RNA, 21 nt, Artificial Sequence
  Synthetic construct
acuaaguagaugguacucuuu

SEQ ID NO: 783 - RNA, 21 nt, Artificial Sequence
  Synthetic construct
augcugacuguccaaccacca

SEQ ID NO: 784 - RNA, 21 nt, Artificial Sequence
  Synthetic construct
ucaacuaaucaagugaacagc

SEQ ID NO: 785 - RNA, 21 nt, Artificial Sequence
  Synthetic construct
uauuacaagggacguucucca

SEQ ID NO: 786 - RNA, 21 nt, Artificial Sequence
  Synthetic construct
ugaaggguaauuggaauuggu

SEQ ID NO: 787 - RNA, 21 nt, Artificial Sequence
  Synthetic construct
ugauucacuccaaaggguguu

SEQ ID NO: 788 - RNA, 21 nt, Artificial Sequence
  Synthetic construct
auuaauucuuggagaguacua

SEQ ID NO: 789 - RNA, 21 nt, Artificial Sequence
  Synthetic construct
auuuggaaugauugcagucca

SEQ ID NO: 790 - RNA, 21 nt, Artificial Sequence
  Synthetic construct
uuaacaugcuuagauacaaag

SEQ ID NO: 791 - RNA, 21 nt, Artificial Sequence
  Synthetic construct
auaaggaauauuuauuaagaa

SEQ ID NO: 792 - RNA, 21 nt, Artificial Sequence
  Synthetic construct
uaauuugcaucauuagaauaa

SEQ ID NO: 793 - RNA, 21 nt, Artificial Sequence
  Synthetic construct
agcagaacaauauuacuuggu

SEQ ID NO: 794 - RNA, 21 nt, Artificial Sequence
  Synthetic construct
cuuaauuugauuuaggucugu

SEQ ID NO: 795 - RNA, 21 nt, Artificial Sequence
  Synthetic construct
aauagaaaugugauugaagau

SEQ ID NO: 796 - RNA, 21 nt, Artificial Sequence
  Synthetic construct
uaugagcaaguaaaucuuuau

SEQ ID NO: 797 - RNA, 21 nt, Artificial Sequence
  Synthetic construct
uuugagaaucuccaucauaau

SEQ ID NO: 798 - RNA, 21 nt, Artificial Sequence
  Synthetic construct
aguucaaacaaugacuuugua

SEQ ID NO: 799 - RNA, 21 nt, Artificial Sequence
  Synthetic construct
uaguuggagagcuaaaugugc

SEQ ID NO: 800 - RNA, 21 nt, Artificial Sequence
  Synthetic construct
auagggugcauucuggucugc

SEQ ID NO: 801 - RNA, 21 nt, Artificial Sequence
  Synthetic construct
uuguagucuccaauaugaagg

SEQ ID NO: 802 - RNA, 21 nt, Artificial Sequence
  Synthetic construct
auaagaagcaagaccaaguca

SEQ ID NO: 803 - RNA, 21 nt, Artificial Sequence
  Synthetic construct
auuauguaauauuaaaggcaa

SEQ ID NO: 804 - RNA, 21 nt, Artificial Sequence
  Synthetic construct
uucuuggagaguacuauaauu

SEQ ID NO: 805 - RNA, 21 nt, Artificial Sequence
  Synthetic construct
uacacuuguuaucaaugcacu

SEQ ID NO: 806 - RNA, 21 nt, Artificial Sequence
  Synthetic construct
aagaagacauguuaacaugcu

SEQ ID NO: 807 - RNA, 21 nt, Artificial Sequence
  Synthetic construct
uuacaagggacguucuccagu

SEQ ID NO: 808 - RNA, 21 nt, Artificial Sequence
  Synthetic construct
caucauuagaauaagaagcaa

SEQ ID NO: 809 - RNA, 21 nt, Artificial Sequence
  Synthetic construct
uucaauaaggaauauuuauua

SEQ ID NO: 810 - RNA, 21 nt, Artificial Sequence
  Synthetic construct
uacaugauauaagguccaggu

SEQ ID NO: 811 - RNA, 21 nt, Artificial Sequence
  Synthetic construct
auuagaacacagaccacuaag

SEQ ID NO: 812 - RNA, 21 nt, Artificial Sequence
  Synthetic construct
auuauuacaagggacguucuc

SEQ ID NO: 813 - RNA, 21 nt, Artificial Sequence
  Synthetic construct
uaguggucaaugcuggaugcc

SEQ ID NO: 814 - RNA, 21 nt, Artificial Sequence
  Synthetic construct
auccauauuguagucuccaau

SEQ ID NO: 815 - RNA, 21 nt, Artificial Sequence
  Synthetic construct
auaugagcaaguaaaucuuua

SEQ ID NO: 816 - RNA, 21 nt, Artificial Sequence
  Synthetic construct
uuugcaucuacaguuguauac

SEQ ID NO: 817 - RNA, 21 nt, Artificial Sequence
  Synthetic construct
aguaugaccagagcgucugga

SEQ ID NO: 818 - RNA, 21 nt, Artificial Sequence
  Synthetic construct
uacaagggacguucuccagua

SEQ ID NO: 819 - RNA, 21 nt, Artificial Sequence
  Synthetic construct
uuacgaggacagucauuagaa

SEQ ID NO: 820 - RNA, 21 nt, Artificial Sequence
  Synthetic construct
auuaagaagacauguuaacau

SEQ ID NO: 821 - RNA, 21 nt, Artificial Sequence
  Synthetic construct
ugaagucugaauguaaauuau

SEQ ID NO: 822 - RNA, 21 nt, Artificial Sequence
  Synthetic construct
acacagaccacuaagaacaau

SEQ ID NO: 823 - RNA, 21 nt, Artificial Sequence
  Synthetic construct
cacuacagaauagagaaccca

SEQ ID NO: 824 - RNA, 21 nt, Artificial Sequence
  Synthetic construct
uucaaaccauauuuauuugaa

SEQ ID NO: 825 - RNA, 21 nt, Artificial Sequence
  Synthetic construct
ucaaauguucuucauuaucac

SEQ ID NO: 826 - RNA, 21 nt, Artificial Sequence
  Synthetic construct
ucaggaauaaaucugcuguaa

SEQ ID NO: 827 - RNA, 21 nt, Artificial Sequence
  Synthetic construct
uauaagguccagguugauuca

SEQ ID NO: 828 - RNA, 21 nt, Artificial Sequence
  Synthetic construct
acaaacacuggaguacaugca

SEQ ID NO: 829 - RNA, 21 nt, Artificial Sequence
  Synthetic construct
uuuauaaauaauauuuaaucu

SEQ ID NO: 830 - RNA, 21 nt, Artificial Sequence
  Synthetic construct
acagagguuaaacaagagcca

SEQ ID NO: 831 - RNA, 21 nt, Artificial Sequence
  Synthetic construct
uguaggacuggaacccacugc

SEQ ID NO: 832 - RNA, 21 nt, Artificial Sequence
  Synthetic construct
uguccaaccaccaucauauuu

SEQ ID NO: 833 - RNA, 21 nt, Artificial Sequence
  Synthetic construct
caguagacuuuaaacauucga

SEQ ID NO: 834 - RNA, 21 nt, Artificial Sequence
  Synthetic construct
acaugcaacacauuccacaaa

SEQ ID NO: 835 - RNA, 21 nt, Artificial Sequence
  Synthetic construct
ucagaaggacauccauuugag

SEQ ID NO: 836 - RNA, 21 nt, Artificial Sequence
  Synthetic construct
ucuaucaucugcuuucuuuuc

SEQ ID NO: 837 - RNA, 21 nt, Artificial Sequence
  Synthetic construct
aucaaugcacugugauucuug

SEQ ID NO: 838 - RNA, 21 nt, Artificial Sequence
  Synthetic construct
uugcaucauuagaauaagaag

SEQ ID NO: 839 - RNA, 21 nt, Artificial Sequence
  Synthetic construct
ucaaagucugcaaaugcugac

SEQ ID NO: 840 - RNA, 21 nt, Artificial Sequence
  Synthetic construct
aguccuauugaguauggucau

SEQ ID NO: 841 - RNA, 21 nt, Artificial Sequence
  Synthetic construct
uaccacauauugaccacuuac

SEQ ID NO: 842 - RNA, 21 nt, Artificial Sequence
  Synthetic construct
aguaacucaaguauuagcccc

SEQ ID NO: 843 - RNA, 21 nt, Artificial Sequence
  Synthetic construct
uaacaugcuuagauacaaagu

SEQ ID NO: 844 - RNA, 21 nt, Artificial Sequence
  Synthetic construct
ucacauacaucaucccauuua

SEQ ID NO: 845 - RNA, 21 nt, Artificial Sequence
  Synthetic construct
aucauuuauaaauaauauuua

SEQ ID NO: 846 - RNA, 21 nt, Artificial Sequence
  Synthetic construct
cuugugacauauucaaaccau

SEQ ID NO: 847 - RNA, 21 nt, Artificial Sequence
  Synthetic construct
ugauugaagauuugcauuccc

SEQ ID NO: 848 - RNA, 21 nt, Artificial Sequence
  Synthetic construct
acuuguuaucaaugcacugug

SEQ ID NO: 849 - RNA, 21 nt, Artificial Sequence
  Synthetic construct
aggcaagucacauagcaucaa

SEQ ID NO: 850 - RNA, 21 nt, Artificial Sequence
  Synthetic construct
uugauucacuccaaagggugu

SEQ ID NO: 851 - RNA, 21 nt, Artificial Sequence
  Synthetic construct
aaugugaaguucacaauacaa

SEQ ID NO: 852 - RNA, 21 nt, Artificial Sequence
  Synthetic construct
aggacagucauuagaacacag

SEQ ID NO: 853 - RNA, 21 nt, Artificial Sequence
  Synthetic construct
uguucuuuaguaugaccagag

SEQ ID NO: 854 - RNA, 21 nt, Artificial Sequence
  Synthetic construct
uauugaguauggucauauugu

SEQ ID NO: 855 - RNA, 21 nt, Artificial Sequence
  Synthetic construct
guagucuccaauaugaagggu

SEQ ID NO: 856 - RNA, 21 nt, Artificial Sequence
  Synthetic construct
auguauuucuauaauuagaug

SEQ ID NO: 857 - RNA, 21 nt, Artificial Sequence
  Synthetic construct
uacucugugcuaggcaccaag

SEQ ID NO: 858 - RNA, 21 nt, Artificial Sequence
  Synthetic construct
uguuaacaugcuuagauacaa

SEQ ID NO: 859 - RNA, 21 nt, Artificial Sequence
  Synthetic construct
auaaaugcaugagaaugugga

SEQ ID NO: 860 - RNA, 21 nt, Artificial Sequence
  Synthetic construct
auuucaaacuggaagguacua

SEQ ID NO: 861 - RNA, 21 nt, Artificial Sequence
  Synthetic construct
uccaagauuccaucuucguaa

SEQ ID NO: 862 - RNA, 21 nt, Artificial Sequence
  Synthetic construct
uccuuuacuuagcacuacaau

SEQ ID NO: 863 - RNA, 21 nt, Artificial Sequence
  Synthetic construct
aauaccaacguagagaugguc

SEQ ID NO: 864 - RNA, 21 nt, Artificial Sequence
  Synthetic construct
acaugauauaagguccagguu

SEQ ID NO: 865 - RNA, 21 nt, Artificial Sequence
  Synthetic construct
aucuuuaugucaaucaccaaa

SEQ ID NO: 866 - RNA, 21 nt, Artificial Sequence
  Synthetic construct
ugaaagauaccuuuacuuugg

SEQ ID NO: 867 - RNA, 21 nt, Artificial Sequence
  Synthetic construct
aaggcaagucugucuuacugu

SEQ ID NO: 868 - RNA, 21 nt, Artificial Sequence
  Synthetic construct
uggaauugguauuucaguugg

SEQ ID NO: 869 - RNA, 21 nt, Artificial Sequence
  Synthetic construct
uauaaauaauauuuaaucucc

SEQ ID NO: 870 - RNA, 21 nt, Artificial Sequence
  Synthetic construct
auaaauucccuccuaauagua

SEQ ID NO: 871 - RNA, 21 nt, Artificial Sequence
  Synthetic construct
auaauuugcaucauuagaaua

SEQ ID NO: 872 - RNA, 21 nt, Artificial Sequence
  Synthetic construct
acuuguaguggucaaugcugg

SEQ ID NO: 873 - RNA, 21 nt, Artificial Sequence
  Synthetic construct
aucugcuucaaaguuauuuuu

SEQ ID NO: 874 - RNA, 21 nt, Artificial Sequence
  Synthetic construct
uaagaagacauguuaacaugc

SEQ ID NO: 875 - RNA, 21 nt, Artificial Sequence
  Synthetic construct
aagcacuucacauacaucauc

SEQ ID NO: 876 - RNA, 21 nt, Artificial Sequence
  Synthetic construct
uacaucauuuauaaauaauau

SEQ ID NO: 877 - RNA, 21 nt, Artificial Sequence
  Synthetic construct
auugaccacuuacucugugcu

SEQ ID NO: 878 - RNA, 21 nt, Artificial Sequence
  Synthetic construct
uucaaugucgucaggaauaaa

SEQ ID NO: 879 - RNA, 21 nt, Artificial Sequence
  Synthetic construct
auacaugauauaagguccagg

SEQ ID NO: 880 - RNA, 21 nt, Artificial Sequence
  Synthetic construct
aaauguucuucauuaucacau

SEQ ID NO: 881 - RNA, 21 nt, Artificial Sequence
  Synthetic construct
auucaaaccauauuuauuuga

SEQ ID NO: 882 - RNA, 21 nt, Artificial Sequence
  Synthetic construct
cauuagaacacagaccacuaa

SEQ ID NO: 883 - RNA, 21 nt, Artificial Sequence
  Synthetic construct
ugcugguugcuuccagaugug

SEQ ID NO: 884 - RNA, 21 nt, Artificial Sequence
  Synthetic construct
auuggaauugguauuucaguu

SEQ ID NO: 885 - RNA, 21 nt, Artificial Sequence
  Synthetic construct
uaauauuaaaggcaagucaca

SEQ ID NO: 886 - RNA, 21 nt, Artificial Sequence
  Synthetic construct
cacuucacauacaucauccca

SEQ ID NO: 887 - RNA, 21 nt, Artificial Sequence
  Synthetic construct
uauccuuuacuuagcacuaca

SEQ ID NO: 888 - RNA, 21 nt, Artificial Sequence
  Synthetic construct
aauacuuuccaauaauuacca

SEQ ID NO: 889 - RNA, 21 nt, Artificial Sequence
  Synthetic construct
ucccuccuaauaguaucugug

SEQ ID NO: 890 - RNA, 21 nt, Artificial Sequence
  Synthetic construct
augugauugaagauuugcauu

SEQ ID NO: 891 - RNA, 21 nt, Artificial Sequence
  Synthetic construct
agaacaauauuacuuggugua

SEQ ID NO: 892 - RNA, 21 nt, Artificial Sequence
  Synthetic construct
aauauuuauuaagaagacaug

SEQ ID NO: 893 - RNA, 21 nt, Artificial Sequence
  Synthetic construct
ucuaucaagucuauguauuuc

SEQ ID NO: 894 - RNA, 21 nt, Artificial Sequence
  Synthetic construct
aauauuaaaggcaagucacau

SEQ ID NO: 895 - RNA, 21 nt, Artificial Sequence
  Synthetic construct
uauuucaguugguugcuguuc

SEQ ID NO: 896 - RNA, 21 nt, Artificial Sequence
  Synthetic construct
guauggaaugacaauuagcug

SEQ ID NO: 897 - RNA, 21 nt, Artificial Sequence
  Synthetic construct
ucacagcuugcauuauuacaa

SEQ ID NO: 898 - RNA, 21 nt, Artificial Sequence
  Synthetic construct
aagucugucuuacugugcuac

SEQ ID NO: 899 - RNA, 21 nt, Artificial Sequence
  Synthetic construct
aguauggucauauuguuagga

SEQ ID NO: 900 - RNA, 21 nt, Artificial Sequence
  Synthetic construct
ucaauaaggaauauuuauuaa

SEQ ID NO: 901 - RNA, 21 nt, Artificial Sequence
  Synthetic construct
aaacaaugacuuuguaagugg

SEQ ID NO: 902 - RNA, 21 nt, Artificial Sequence
  Synthetic construct
uggauucauuugugauaccaa

SEQ ID NO: 903 - RNA, 21 nt, Artificial Sequence
  Synthetic construct
uauuaaaggcaagucacauag

SEQ ID NO: 904 - RNA, 21 nt, Artificial Sequence
  Synthetic construct
ugggaauuuggaaugauugca

SEQ ID NO: 905 - RNA, 21 nt, Artificial Sequence
  Synthetic construct
aaucuuguaggacuggaaccc

SEQ ID NO: 906 - RNA, 21 nt, Artificial Sequence
  Synthetic construct
aucuccaucaaagucugcaaa

SEQ ID NO: 907 - RNA, 21 nt, Artificial Sequence
  Synthetic construct
uuagaacacagaccacuaaga

SEQ ID NO: 908 - RNA, 21 nt, Artificial Sequence
  Synthetic construct
ucacuaaguagaugguacucu

SEQ ID NO: 909 - RNA, 21 nt, Artificial Sequence
  Synthetic construct
uuucuauaauuagauguauaa

SEQ ID NO: 910 - RNA, 21 nt, Artificial Sequence
  Synthetic construct
ugcauugaagucugaauguaa

SEQ ID NO: 911 - RNA, 21 nt, Artificial Sequence
  Synthetic construct
uuugcgcuccgaccuaaacca

SEQ ID NO: 912 - RNA, 21 nt, Artificial Sequence
  Synthetic construct
ugauuuaggucugucagcucc

SEQ ID NO: 913 - RNA, 21 nt, Artificial Sequence
  Synthetic construct
aaccggugggcuucuugucgu

SEQ ID NO: 914 - RNA, 21 nt, Artificial Sequence
  Synthetic construct
ugaagauuugcauucccagau

SEQ ID NO: 915 - RNA, 21 nt, Artificial Sequence
  Synthetic construct
uuauuugaauacuuuccaaua

SEQ ID NO: 916 - RNA, 21 nt, Artificial Sequence
  Synthetic construct
ucccaguagacuuuaaacauu

SEQ ID NO: 917 - RNA, 21 nt, Artificial Sequence
  Synthetic construct
ucagucagaucaauaaaugca

SEQ ID NO: 918 - RNA, 21 nt, Artificial Sequence
  Synthetic construct
cauccauuugagaaucuccau

SEQ ID NO: 919 - RNA, 21 nt, Artificial Sequence
  Synthetic construct
uagaaaugugauugaagauuu

SEQ ID NO: 920 - RNA, 21 nt, Artificial Sequence
  Synthetic construct
acagcuccuaauucacucuug

SEQ ID NO: 921 - RNA, 21 nt, Artificial Sequence
  Synthetic construct
uuaggucugucagcucccagu

SEQ ID NO: 922 - RNA, 21 nt, Artificial Sequence
  Synthetic construct
aagacauguuaacaugcuuag

SEQ ID NO: 923 - RNA, 21 nt, Artificial Sequence
  Synthetic construct
auacccauuugcaucuacagu

SEQ ID NO: 924 - RNA, 21 nt, Artificial Sequence
  Synthetic construct
aaaucuuuaugucaaucacca

SEQ ID NO: 925 - RNA, 21 nt, Artificial Sequence
  Synthetic construct
cagagguuaaacaagagccaa

SEQ ID NO: 926 - RNA, 21 nt, Artificial Sequence
  Synthetic construct
aucaggaauuagaucaccauu

SEQ ID NO: 927 - RNA, 21 nt, Artificial Sequence
  Synthetic construct
ucccauuuaauguuuacagua

SEQ ID NO: 928 - RNA, 21 nt, Artificial Sequence
  Synthetic construct
aggcaagucugucuuacugug

SEQ ID NO: 929 - RNA, 21 nt, Artificial Sequence
  Synthetic construct
ucucagugaacuauaaagaaa

SEQ ID NO: 930 - RNA, 21 nt, Artificial Sequence
  Synthetic construct
uauugaccacuuacucugugc

SEQ ID NO: 931 - RNA, 21 nt, Artificial Sequence
  Synthetic construct
auguaaauuauagacuucucc

SEQ ID NO: 932 - RNA, 21 nt, Artificial Sequence
  Synthetic construct
ucagaucaauaaaugcaugag

SEQ ID NO: 933 - RNA, 21 nt, Artificial Sequence
  Synthetic construct
ugagaauguggaauucgcauu

SEQ ID NO: 934 - RNA, 21 nt, Artificial Sequence
  Synthetic construct
uugcaucuacaguuguauaca

SEQ ID NO: 935 - RNA, 21 nt, Artificial Sequence
  Synthetic construct
cuuauugcugaaaucuuguag

SEQ ID NO: 936 - RNA, 21 nt, Artificial Sequence
  Synthetic construct
acuugguguaagauacaguuu

SEQ ID NO: 937 - RNA, 21 nt, Artificial Sequence
  Synthetic construct
auauuguagucuccaauauga

SEQ ID NO: 938 - RNA, 21 nt, Artificial Sequence
  Synthetic construct
acauccauuugagaaucucca

SEQ ID NO: 939 - RNA, 21 nt, Artificial Sequence
  Synthetic construct
uuaucaaugcacugugauucu

SEQ ID NO: 940 - RNA, 21 nt, Artificial Sequence
  Synthetic construct
auuaccaugggauacaucauu

SEQ ID NO: 941 - RNA, 21 nt, Artificial Sequence
  Synthetic construct
acuucacauacaucaucccau

SEQ ID NO: 942 - RNA, 21 nt, Artificial Sequence
  Synthetic construct
aucaaagucugcaaaugcuga

SEQ ID NO: 943 - RNA, 21 nt, Artificial Sequence
  Synthetic construct
auccuuaauuugauuuagguc

SEQ ID NO: 944 - RNA, 21 nt, Artificial Sequence
  Synthetic construct
ugaagcugaaugccuaaugac

SEQ ID NO: 945 - RNA, 21 nt, Artificial Sequence
  Synthetic construct
agcaagaccaagucaagugga

SEQ ID NO: 946 - RNA, 21 nt, Artificial Sequence
  Synthetic construct
auugcaguccacucuuguuuu

SEQ ID NO: 947 - RNA, 21 nt, Artificial Sequence
  Synthetic construct
caaacaaugacuuuguaagug

SEQ ID NO: 948 - RNA, 21 nt, Artificial Sequence
  Synthetic construct
ucuaauaagaucaucuaaaau

SEQ ID NO: 949 - RNA, 21 nt, Artificial Sequence
  Synthetic construct
auaacagcuccuaauucacuc

SEQ ID NO: 950 - RNA, 21 nt, Artificial Sequence
  Synthetic construct
uaaggaauauuuauuaagaag

SEQ ID NO: 951 - RNA, 21 nt, Artificial Sequence
  Synthetic construct
aaggguguuaucuuacgagga

SEQ ID NO: 952 - RNA, 21 nt, Artificial Sequence
  Synthetic construct
uaaugacaacuaccacauauu

SEQ ID NO: 953 - RNA, 21 nt, Artificial Sequence
  Synthetic construct
uauuacuugguguaagauaca

SEQ ID NO: 954 - RNA, 21 nt, Artificial Sequence
  Synthetic construct
aucauuagaauaagaagcaag

SEQ ID NO: 955 - RNA, 21 nt, Artificial Sequence
  Synthetic construct
caauauaguacugacagagaa

SEQ ID NO: 956 - RNA, 21 nt, Artificial Sequence
  Synthetic construct
auuguagucuccaauaugaag

SEQ ID NO: 957 - RNA, 21 nt, Artificial Sequence
  Synthetic construct
ugacaacuaccacauauugac

SEQ ID NO: 958 - RNA, 21 nt, Artificial Sequence
  Synthetic construct
acuacaauguccaagauucca

SEQ ID NO: 959 - RNA, 21 nt, Artificial Sequence
  Synthetic construct
ucaggaauuagaucaccauug

SEQ ID NO: 960 - RNA, 21 nt, Artificial Sequence
  Synthetic construct
accggugggcuucuugucguu

SEQ ID NO: 961 - RNA, 21 nt, Artificial Sequence
  Synthetic construct
auguccaagauuccaucuucg

SEQ ID NO: 962 - RNA, 21 nt, Artificial Sequence
  Synthetic construct
aauaaaugcaugagaaugugg

SEQ ID NO: 963 - RNA, 21 nt, Artificial Sequence
  Synthetic construct
aagcaagaccaagucaagugg

SEQ ID NO: 964 - RNA, 21 nt, Artificial Sequence
  Synthetic construct
ucuucguaaaugucaaagaag

SEQ ID NO: 965 - RNA, 21 nt, Artificial Sequence
  Synthetic construct
uuaccaugggauacaucauuu

SEQ ID NO: 966 - RNA, 21 nt, Artificial Sequence
  Synthetic construct
uuacagagguuaaacaagagc

SEQ ID NO: 967 - RNA, 21 nt, Artificial Sequence
  Synthetic construct
uugcugaaaucuuguaggacu

SEQ ID NO: 968 - RNA, 21 nt, Artificial Sequence
  Synthetic construct
uuggaaugauugcaguccacu

SEQ ID NO: 969 - RNA, 21 nt, Artificial Sequence
  Synthetic construct
uaugaaggguaauuggaauug

SEQ ID NO: 970 - RNA, 21 nt, Artificial Sequence
  Synthetic construct
augagcaaguaaaucuuuaug

SEQ ID NO: 971 - RNA, 21 nt, Artificial Sequence
  Synthetic construct
uuuguaagugguugaauuagg

SEQ ID NO: 972 - RNA, 21 nt, Artificial Sequence
  Synthetic construct
aacuaccacauauugaccacu

SEQ ID NO: 973 - RNA, 21 nt, Artificial Sequence
  Synthetic construct
ucaaacaaugacuuuguaagu

SEQ ID NO: 974 - RNA, 21 nt, Artificial Sequence
  Synthetic construct
aauucuuggagaguacuauaa

SEQ ID NO: 975 - RNA, 21 nt, Artificial Sequence
  Synthetic construct
cuuacugugcuaccaagucag

SEQ ID NO: 976 - RNA, 21 nt, Artificial Sequence
  Synthetic construct
acaauuagcugggaauuugga

SEQ ID NO: 977 - RNA, 21 nt, Artificial Sequence
  Synthetic construct
uggaguacaugcaacacauuc

SEQ ID NO: 978 - RNA, 21 nt, Artificial Sequence
  Synthetic construct
agaaaugugauugaagauuug

SEQ ID NO: 979 - RNA, 21 nt, Artificial Sequence
  Synthetic construct
ugcauucccagaugcugccua

SEQ ID NO: 980 - RNA, 21 nt, Artificial Sequence
  Synthetic construct
uaaauucccuccuaauaguau

SEQ ID NO: 981 - RNA, 21 nt, Artificial Sequence
  Synthetic construct
auucuuuguauauccuuuacu

SEQ ID NO: 982 - RNA, 21 nt, Artificial Sequence
  Synthetic construct
uuccaauaauuaccaugggau

SEQ ID NO: 983 - RNA, 21 nt, Artificial Sequence
  Synthetic construct
uucuugaaagauaccuuuacu

SEQ ID NO: 984 - RNA, 21 nt, Artificial Sequence
  Synthetic construct
ugagcaaguaaaucuuuaugu

SEQ ID NO: 985 - RNA, 21 nt, Artificial Sequence
  Synthetic construct
cugaauguaaauuauagacuu

SEQ ID NO: 986 - RNA, 21 nt, Artificial Sequence
  Synthetic construct
ugugaggguauggaaugacaa

SEQ ID NO: 987 - RNA, 21 nt, Artificial Sequence
  Synthetic construct
aauguucuucauuaucacaug

SEQ ID NO: 988 - RNA, 21 nt, Artificial Sequence
  Synthetic construct
acagacaccgaugagagcuau

SEQ ID NO: 989 - RNA, 21 nt, Artificial Sequence
  Synthetic construct
ccaacuucgagggacauugug

SEQ ID NO: 990 - RNA, 21 nt, Artificial Sequence
  Synthetic construct
uaguacugacagagaaguuuc

SEQ ID NO: 991 - RNA, 21 nt, Artificial Sequence
  Synthetic construct
uucacagcuugcauuauuaca

SEQ ID NO: 992 - RNA, 21 nt, Artificial Sequence
  Synthetic construct
cauauugaccacuuacucugu

SEQ ID NO: 993 - RNA, 21 nt, Artificial Sequence
  Synthetic construct
agggacuacacuuguuaucaa

SEQ ID NO: 994 - RNA, 21 nt, Artificial Sequence
  Synthetic construct
uuaucacaugauaaggauaag

SEQ ID NO: 995 - RNA, 21 nt, Artificial Sequence
  Synthetic construct
aauuaccaugggauacaucau

SEQ ID NO: 996 - RNA, 21 nt, Artificial Sequence
  Synthetic construct
acuacacuuguuaucaaugca

SEQ ID NO: 997 - RNA, 21 nt, Artificial Sequence
  Synthetic construct
uacaauguccaagauuccauc

SEQ ID NO: 998 - RNA, 21 nt, Artificial Sequence
  Synthetic construct
auuugcauugaagucugaaug

SEQ ID NO: 999 - RNA, 21 nt, Artificial Sequence
  Synthetic construct
augaaggguaauuggaauugg

SEQ ID NO: 1000 - RNA, 21 nt, Artificial Sequence
  Synthetic construct
acuacagaauagagaacccaa

SEQ ID NO: 1001 - RNA, 21 nt, Artificial Sequence
  Synthetic construct
gagagcuauagcaguaagcag

SEQ ID NO: 1002 - RNA, 21 nt, Artificial Sequence
  Synthetic construct
agaauguggaauucgcauuuu

SEQ ID NO: 1003 - RNA, 21 nt, Artificial Sequence
  Synthetic construct
uccagguugauucacuccaaa

SEQ ID NO: 1004 - RNA, 21 nt, Artificial Sequence
  Synthetic construct
uuucaagaaaucaaauguucu

SEQ ID NO: 1005 - RNA, 21 nt, Artificial Sequence
  Synthetic construct
accuaaaccaagcacguugua

SEQ ID NO: 1006 - RNA, 21 nt, Artificial Sequence
  Synthetic construct
aauauaguacugacagagaag

SEQ ID NO: 1007 - RNA, 21 nt, Artificial Sequence
  Synthetic construct
gaucucacuaaguagauggua

SEQ ID NO: 1008 - RNA, 21 nt, Artificial Sequence
  Synthetic construct
uguacagcacuacagaauaga

SEQ ID NO: 1009 - RNA, 21 nt, Artificial Sequence
  Synthetic construct
uguaauauuaaaggcaaguca

SEQ ID NO: 1010 - RNA, 21 nt, Artificial Sequence
  Synthetic construct
uuccuuucaagaaaucaaaug

SEQ ID NO: 1011 - RNA, 21 nt, Artificial Sequence
  Synthetic construct
auccauuugagaaucuccauc

SEQ ID NO: 1012 - RNA, 21 nt, Artificial Sequence
  Synthetic construct
uaucacaugauaaggauaagu

SEQ ID NO: 1013 - RNA, 21 nt, Artificial Sequence
  Synthetic construct
caaugcacugugauucuugaa

SEQ ID NO: 1014 - RNA, 21 nt, Artificial Sequence
  Synthetic construct
uggagagcuaaaugugcggau

SEQ ID NO: 1015 - RNA, 21 nt, Artificial Sequence
  Synthetic construct
uaagauuauaaauacacaaac

SEQ ID NO: 1016 - RNA, 21 nt, Artificial Sequence
  Synthetic construct
auaagauuauaaauacacaaa

SEQ ID NO: 1017 - RNA, 21 nt, Artificial Sequence
  Synthetic construct
ucuuggagaguacuauaauuu

SEQ ID NO: 1018 - RNA, 21 nt, Artificial Sequence
  Synthetic construct
aacaauauuacuugguguaag

SEQ ID NO: 1019 - RNA, 21 nt, Artificial Sequence
  Synthetic construct
ucaagaaaucaaauguucuuc

SEQ ID NO: 1020 - RNA, 21 nt, Artificial Sequence
  Synthetic construct
ugucgucaggaauaaaucugc

SEQ ID NO: 1021 - RNA, 21 nt, Artificial Sequence
  Synthetic construct
gaguacaugcaacacauucca

SEQ ID NO: 1022 - RNA, 21 nt, Artificial Sequence
  Synthetic construct
uaugaccagagcgucuggaua

SEQ ID NO: 1023 - RNA, 21 nt, Artificial Sequence
  Synthetic construct
uccaaccaccaucauauuuug

SEQ ID NO: 1024 - RNA, 21 nt, Artificial Sequence
  Synthetic construct
cugcaaaugcugacuguccaa

SEQ ID NO: 1025 - RNA, 21 nt, Artificial Sequence
  Synthetic construct
uccgaccuaaaccaagcacgu

SEQ ID NO: 1026 - RNA, 21 nt, Artificial Sequence
  Synthetic construct
ugucagcucccaguagacuuu

SEQ ID NO: 1027 - RNA, 21 nt, Artificial Sequence
  Synthetic construct
auucuaucaagucuauguauu

SEQ ID NO: 1028 - RNA, 21 nt, Artificial Sequence
  Synthetic construct
cuuagcacuacaauguccaag

SEQ ID NO: 1029 - RNA, 21 nt, Artificial Sequence
  Synthetic construct
ugagaauagaaaugugauuga

SEQ ID NO: 1030 - RNA, 21 nt, Artificial Sequence
  Synthetic construct
aagcacguuguaugguaguug

SEQ ID NO: 1031 - RNA, 21 nt, Artificial Sequence
  Synthetic construct
uagggugcauucuggucugcc

SEQ ID NO: 1032 - RNA, 21 nt, Artificial Sequence
  Synthetic construct
ucaaugcacugugauucuuga

SEQ ID NO: 1033 - RNA, 21 nt, Artificial Sequence
  Synthetic construct
uccaaguguuugagaauagaa

SEQ ID NO: 1034 - RNA, 21 nt, Artificial Sequence
  Synthetic construct
uccaauaugaaggguaauugg

SEQ ID NO: 1035 - RNA, 21 nt, Artificial Sequence
  Synthetic construct
cuuuccaauaauuaccauggg

SEQ ID NO: 1036 - RNA, 21 nt, Artificial Sequence
  Synthetic construct
uuaauaugagcaaguaaaucu

SEQ ID NO: 1037 - RNA, 21 nt, Artificial Sequence
  Synthetic construct
uuuccuuucaagaaaucaaau

SEQ ID NO: 1038 - RNA, 21 nt, Artificial Sequence
  Synthetic construct
ugacuuuguaagugguugaau

SEQ ID NO: 1039 - RNA, 21 nt, Artificial Sequence
  Synthetic construct
guaagcagaacaauauuacuu

SEQ ID NO: 1040 - RNA, 21 nt, Artificial Sequence
  Synthetic construct
auuccaucuucguaaauguca

SEQ ID NO: 1041 - RNA, 21 nt, Artificial Sequence
  Synthetic construct
ucuuacgaggacagucauuag

SEQ ID NO: 1042 - RNA, 21 nt, Artificial Sequence
  Synthetic construct
aaaugugauugaagauuugca

SEQ ID NO: 1043 - RNA, 21 nt, Artificial Sequence
  Synthetic construct
acauauucaaaccauauuuau

SEQ ID NO: 1044 - RNA, 21 nt, Artificial Sequence
  Synthetic construct
ugugacauauucaaaccauau

SEQ ID NO: 1045 - RNA, 21 nt, Artificial Sequence
  Synthetic construct
uuugaauacuuuccaauaauu

SEQ ID NO: 1046 - RNA, 21 nt, Artificial Sequence
  Synthetic construct
aaugccuaaugacuccgugau

SEQ ID NO: 1047 - RNA, 21 nt, Artificial Sequence
  Synthetic construct
auuugauuuaggucugucagc

SEQ ID NO: 1048 - RNA, 21 nt, Artificial Sequence
  Synthetic construct
auaggcaucacauguccauuu

SEQ ID NO: 1049 - RNA, 21 nt, Artificial Sequence
  Synthetic construct
ucaugaugcaaauaagauuau

SEQ ID NO: 1050 - RNA, 21 nt, Artificial Sequence
  Synthetic construct
aguugguugcuguucauccac

SEQ ID NO: 1051 - RNA, 21 nt, Artificial Sequence
  Synthetic construct
aagucuauguauuucuauaau

SEQ ID NO: 1052 - RNA, 21 nt, Artificial Sequence
  Synthetic construct
ugcacugugauucuugaaaga

SEQ ID NO: 1053 - RNA, 21 nt, Artificial Sequence
  Synthetic construct
ugacaauuagcugggaauuug

SEQ ID NO: 1054 - RNA, 21 nt, Artificial Sequence
  Synthetic construct
uguccauuugcauacuagaaa

SEQ ID NO: 1055 - RNA, 21 nt, Artificial Sequence
  Synthetic construct
auagaaaugugauugaagauu

SEQ ID NO: 1056 - RNA, 21 nt, Artificial Sequence
  Synthetic construct
uccaacuucgagggacauugu

SEQ ID NO: 1057 - RNA, 21 nt, Artificial Sequence
  Synthetic construct
uugagaaucuccaucauaauc

SEQ ID NO: 1058 - RNA, 21 nt, Artificial Sequence
  Synthetic construct
gaucacuauauuguaugccau

SEQ ID NO: 1059 - RNA, 21 nt, Artificial Sequence
  Synthetic construct
uucaucccagaucucacuaag

SEQ ID NO: 1060 - RNA, 21 nt, Artificial Sequence
  Synthetic construct
ugaguauggucauauuguuag

SEQ ID NO: 1061 - RNA, 21 nt, Artificial Sequence
  Synthetic construct
ugugcuaccaagucagaguac

SEQ ID NO: 1062 - RNA, 21 nt, Artificial Sequence
  Synthetic construct
caaacuggaagguacuagugg

SEQ ID NO: 1063 - RNA, 21 nt, Artificial Sequence
  Synthetic construct
acacaaacacuggaguacaug

SEQ ID NO: 1064 - RNA, 21 nt, Artificial Sequence
  Synthetic construct
auaucaggaauuagaucacca

SEQ ID NO: 1065 - RNA, 21 nt, Artificial Sequence
  Synthetic construct
aauguuuacaguaacucaagu

SEQ ID NO: 1066 - RNA, 21 nt, Artificial Sequence
  Synthetic construct
uguuuacaguaacucaaguau

SEQ ID NO: 1067 - RNA, 21 nt, Artificial Sequence
  Synthetic construct
acaugcuuagauacaaaguaa

SEQ ID NO: 1068 - RNA, 21 nt, Artificial Sequence
  Synthetic construct
aucaccauugaaauccauaau

SEQ ID NO: 1069 - RNA, 21 nt, Artificial Sequence
  Synthetic construct
uauuucuucaugccugaaaau

SEQ ID NO: 1070 - RNA, 21 nt, Artificial Sequence
  Synthetic construct
ucaagucuauguauuucuaua

SEQ ID NO: 1071 - RNA, 21 nt, Artificial Sequence
  Synthetic construct
cagaacaauauuacuuggugu

SEQ ID NO: 1072 - RNA, 21 nt, Artificial Sequence
  Synthetic construct
uaguuaauaugagcaaguaaa

SEQ ID NO: 1073 - RNA, 21 nt, Artificial Sequence
  Synthetic construct
cugaaaucuuguaggacugga

SEQ ID NO: 1074 - RNA, 21 nt, Artificial Sequence
  Synthetic construct
aaacauucgacgcgccucuuc

SEQ ID NO: 1075 - RNA, 21 nt, Artificial Sequence
  Synthetic construct
uuccugcucauuuaauuauuu

SEQ ID NO: 1076 - RNA, 21 nt, Artificial Sequence
  Synthetic construct
ugggaagauaugucagaagga

SEQ ID NO: 1077 - RNA, 21 nt, Artificial Sequence
  Synthetic construct
uuucaauaaggaauauuuauu

SEQ ID NO: 1078 - RNA, 21 nt, Artificial Sequence
  Synthetic construct
augacuccgugauauauucac

SEQ ID NO: 1079 - RNA, 21 nt, Artificial Sequence
  Synthetic construct
caaacacuggaguacaugcaa

SEQ ID NO: 1080 - RNA, 21 nt, Artificial Sequence
  Synthetic construct
aaugacuuuguaagugguuga

SEQ ID NO: 1081 - RNA, 21 nt, Artificial Sequence
  Synthetic construct
aaugucgucaggaauaaaucu

SEQ ID NO: 1082 - RNA, 21 nt, Artificial Sequence
  Synthetic construct
uuccauuauguaauauuaaag

SEQ ID NO: 1083 - RNA, 21 nt, Artificial Sequence
  Synthetic construct
uuugcauucccagaugcugcc

SEQ ID NO: 1084 - RNA, 21 nt, Artificial Sequence
  Synthetic construct
ucauauuguuaggaucuaaug

SEQ ID NO: 1085 - RNA, 21 nt, Artificial Sequence
  Synthetic construct
aaguguuugagaauagaaaug

SEQ ID NO: 1086 - RNA, 21 nt, Artificial Sequence
  Synthetic construct
aagauaacagcuccuaauuca

SEQ ID NO: 1087 - RNA, 21 nt, Artificial Sequence
  Synthetic construct
auucuugaaagauaccuuuac

SEQ ID NO: 1088 - RNA, 21 nt, Artificial Sequence
  Synthetic construct
aguuuaaggcaagucugucuu

SEQ ID NO: 1089 - RNA, 21 nt, Artificial Sequence
  Synthetic construct
acuaccacauauugaccacuu

SEQ ID NO: 1090 - RNA, 21 nt, Artificial Sequence
  Synthetic construct
aggaguuuaaggcaagucugu

SEQ ID NO: 1091 - RNA, 21 nt, Artificial Sequence
  Synthetic construct
uucaguugguugcuguucauc

SEQ ID NO: 1092 - RNA, 21 nt, Artificial Sequence
  Synthetic construct
auuuaauguuuacaguaacuc

SEQ ID NO: 1093 - RNA, 21 nt, Artificial Sequence
  Synthetic construct
ucacauguccauuugcauacu

SEQ ID NO: 1094 - RNA, 21 nt, Artificial Sequence
  Synthetic construct
ugcccuuauugcugaaaucuu

SEQ ID NO: 1095 - RNA, 21 nt, Artificial Sequence
  Synthetic construct
uguauaagucuaauaagauca

SEQ ID NO: 1096 - RNA, 21 nt, Artificial Sequence
  Synthetic construct
uacagagguuaaacaagagcc

SEQ ID NO: 1097 - RNA, 21 nt, Artificial Sequence
  Synthetic construct
aauuagauguauaagucuaau

SEQ ID NO: 1098 - RNA, 21 nt, Artificial Sequence
  Synthetic construct
gagaauagaaaugugauugaa

SEQ ID NO: 1099 - RNA, 21 nt, Artificial Sequence
  Synthetic construct
uguccaucuccaucaaagucu

SEQ ID NO: 1100 - RNA, 21 nt, Artificial Sequence
  Synthetic construct
uucaaacaaugacuuuguaag

SEQ ID NO: 1101 - RNA, 21 nt, Artificial Sequence
  Synthetic construct
aauguaaauuauagacuucuc

SEQ ID NO: 1102 - RNA, 21 nt, Artificial Sequence
  Synthetic construct
guauacaugauauaaggucca

SEQ ID NO: 1103 - RNA, 21 nt, Artificial Sequence
  Synthetic construct
agacuucuccaaguguuugag

SEQ ID NO: 1104 - RNA, 21 nt, Artificial Sequence
  Synthetic construct
uacagaauagagaacccaaau

SEQ ID NO: 1105 - RNA, 21 nt, Artificial Sequence
  Synthetic construct
cuuguaguggucaaugcugga

SEQ ID NO: 1106 - RNA, 21 nt, Artificial Sequence
  Synthetic construct
uuuguauauccuuuacuuagc

SEQ ID NO: 1107 - RNA, 21 nt, Artificial Sequence
  Synthetic construct
uucuccaaguguuugagaaua

SEQ ID NO: 1108 - RNA, 21 nt, Artificial Sequence
  Synthetic construct
ucaaaccauauuuauuugaau

SEQ ID NO: 1109 - RNA, 21 nt, Artificial Sequence
  Synthetic construct
aaugacuccgugauauauuca

SEQ ID NO: 1110 - RNA, 21 nt, Artificial Sequence
  Synthetic construct
auucuuggagaguacuauaau

SEQ ID NO: 1111 - RNA, 21 nt, Artificial Sequence
  Synthetic construct
caucaaagucugcaaaugcug

SEQ ID NO: 1112 - RNA, 21 nt, Artificial Sequence
  Synthetic construct
agacauguuaacaugcuuaga

SEQ ID NO: 1113 - RNA, 21 nt, Artificial Sequence
  Synthetic construct
ugugauugaagauuugcauuc

SEQ ID NO: 1114 - RNA, 21 nt, Artificial Sequence
  Synthetic construct
aagauaccuuuacuuuggguu

SEQ ID NO: 1115 - RNA, 21 nt, Artificial Sequence
  Synthetic construct
agaauauuucuucaugccuga

SEQ ID NO: 1116 - RNA, 21 nt, Artificial Sequence
  Synthetic construct
auuugcaucuacaguuguaua

SEQ ID NO: 1117 - RNA, 21 nt, Artificial Sequence
  Synthetic construct
uccauuugagaaucuccauca

SEQ ID NO: 1118 - RNA, 21 nt, Artificial Sequence
  Synthetic construct
uccaaagaauauuucuucaug

SEQ ID NO: 1119 - RNA, 21 nt, Artificial Sequence
  Synthetic construct
aauaauuaccaugggauacau

SEQ ID NO: 1120 - RNA, 21 nt, Artificial Sequence
  Synthetic construct
uggaaaugugaaguucacaau

SEQ ID NO: 1121 - RNA, 21 nt, Artificial Sequence
  Synthetic construct
acaccgaugagagcuauagca

SEQ ID NO: 1122 - RNA, 21 nt, Artificial Sequence
  Synthetic construct
acuggaguacaugcaacacau

SEQ ID NO: 1123 - RNA, 21 nt, Artificial Sequence
  Synthetic construct
aggucugucagcucccaguag

SEQ ID NO: 1124 - RNA, 21 nt, Artificial Sequence
  Synthetic construct
uuaggaguuuaaggcaagucu

SEQ ID NO: 1125 - RNA, 21 nt, Artificial Sequence
  Synthetic construct
auauaguacugacagagaagu

SEQ ID NO: 1126 - RNA, 21 nt, Artificial Sequence
  Synthetic construct
ccauuugagaaucuccaucau

SEQ ID NO: 1127 - RNA, 21 nt, Artificial Sequence
  Synthetic construct
ugucuuacugugcuaccaagu

SEQ ID NO: 1128 - RNA, 21 nt, Artificial Sequence
  Synthetic construct
acagcuugcauuauuacaagg

SEQ ID NO: 1129 - RNA, 21 nt, Artificial Sequence
  Synthetic construct
aguagacuuuaaacauucgac

SEQ ID NO: 1130 - RNA, 21 nt, Artificial Sequence
  Synthetic construct
uacaguaacucaaguauuagc

SEQ ID NO: 1131 - RNA, 21 nt, Artificial Sequence
  Synthetic construct
ugagagcuauagcaguaagca

SEQ ID NO: 1132 - RNA, 21 nt, Artificial Sequence
  Synthetic construct
accauugaaauccauaauuag

SEQ ID NO: 1133 - RNA, 21 nt, Artificial Sequence
  Synthetic construct
agcuugcauuauuacaaggga

SEQ ID NO: 1134 - RNA, 21 nt, Artificial Sequence
  Synthetic construct
cauauuucaaacuggaaggua

SEQ ID NO: 1135 - RNA, 21 nt, Artificial Sequence
  Synthetic construct
aaccaagcacguuguauggua

SEQ ID NO: 1136 - RNA, 21 nt, Artificial Sequence
  Synthetic construct
ucugaauguaaauuauagacu

SEQ ID NO: 1137 - RNA, 21 nt, Artificial Sequence
  Synthetic construct
accauauuuauuugaauacuu

SEQ ID NO: 1138 - RNA, 21 nt, Artificial Sequence
  Synthetic construct
cuuguuaucaaugcacuguga

SEQ ID NO: 1139 - RNA, 21 nt, Artificial Sequence
  Synthetic construct
aaaucaaauguucuucauuau

SEQ ID NO: 1140 - RNA, 21 nt, Artificial Sequence
  Synthetic construct
uauggucauauuguuaggauc

SEQ ID NO: 1141 - RNA, 21 nt, Artificial Sequence
  Synthetic construct
aucuucagucagaucaauaaa

SEQ ID NO: 1142 - RNA, 21 nt, Artificial Sequence
  Synthetic construct
uaugguaguuggagagcuaaa

SEQ ID NO: 1143 - RNA, 21 nt, Artificial Sequence
  Synthetic construct
uccuuaauuugauuuaggucu

SEQ ID NO: 1144 - RNA, 21 nt, Artificial Sequence
  Synthetic construct
aucccagaucucacuaaguag

SEQ ID NO: 1145 - RNA, 21 nt, Artificial Sequence
  Synthetic construct
aauaagaagcaagaccaaguc

SEQ ID NO: 1146 - RNA, 21 nt, Artificial Sequence
  Synthetic construct
aaaccggugggcuucuugucg

SEQ ID NO: 1147 - RNA, 21 nt, Artificial Sequence
  Synthetic construct
agaucucacuaaguagauggu

SEQ ID NO: 1148 - RNA, 21 nt, Artificial Sequence
  Synthetic construct
auuucuauaauuagauguaua

SEQ ID NO: 1149 - RNA, 21 nt, Artificial Sequence
  Synthetic construct
uggaaugauugcaguccacuc

SEQ ID NO: 1150 - RNA, 21 nt, Artificial Sequence
  Synthetic construct
uucagucagaucaauaaaugc

SEQ ID NO: 1151 - RNA, 21 nt, Artificial Sequence
  Synthetic construct
cacauguccauuugcauacua

SEQ ID NO: 1152 - RNA, 21 nt, Artificial Sequence
  Synthetic construct
gucaggaauaaaucugcugua

SEQ ID NO: 1153 - RNA, 21 nt, Artificial Sequence
  Synthetic construct
acccauuugcaucuacaguug

SEQ ID NO: 1154 - RNA, 21 nt, Artificial Sequence
  Synthetic construct
aggaucuaauguuugauuuug

SEQ ID NO: 1155 - RNA, 21 nt, Artificial Sequence
  Synthetic construct
auauucaaaccauauuuauuu

SEQ ID NO: 1156 - RNA, 21 nt, Artificial Sequence
  Synthetic construct
agguugauucacuccaaaggg

SEQ ID NO: 1157 - RNA, 21 nt, Artificial Sequence
  Synthetic construct
gaaugauugcaguccacucuu

SEQ ID NO: 1158 - RNA, 21 nt, Artificial Sequence
  Synthetic construct
ucgacgcgccucuucacagcu

SEQ ID NO: 1159 - RNA, 21 nt, Artificial Sequence
  Synthetic construct
augacaauuagcugggaauuu

SEQ ID NO: 1160 - RNA, 21 nt, Artificial Sequence
  Synthetic construct
agaauaagaagcaagaccaag

SEQ ID NO: 1161 - RNA, 21 nt, Artificial Sequence
  Synthetic construct
agcuaagcacuucacauacau

SEQ ID NO: 1162 - RNA, 21 nt, Artificial Sequence
  Synthetic construct
uccauuugcauacuagaaaau

SEQ ID NO: 1163 - RNA, 21 nt, Artificial Sequence
  Synthetic construct
cacauauugaccacuuacucu

SEQ ID NO: 1164 - RNA, 21 nt, Artificial Sequence
  Synthetic construct
auauuuauuugaauacuuucc

SEQ ID NO: 1165 - RNA, 21 nt, Artificial Sequence
  Synthetic construct
aauugguauuucaguugguug

SEQ ID NO: 1166 - RNA, 21 nt, Artificial Sequence
  Synthetic construct
agcacuacaauguccaagauu

SEQ ID NO: 1167 - RNA, 21 nt, Artificial Sequence
  Synthetic construct
augccuaaugacuccgugaua

SEQ ID NO: 1168 - RNA, 21 nt, Artificial Sequence
  Synthetic construct
ucaucaugaugcaaauaagau

SEQ ID NO: 1169 - RNA, 21 nt, Artificial Sequence
  Synthetic construct
accugcugugaugaagcugaa

SEQ ID NO: 1170 - RNA, 21 nt, Artificial Sequence
  Synthetic construct
aaacacuggaguacaugcaac

SEQ ID NO: 1171 - RNA, 21 nt, Artificial Sequence
  Synthetic construct
ugcaugagaauguggaauucg

SEQ ID NO: 1172 - RNA, 21 nt, Artificial Sequence
  Synthetic construct
guccaagauuccaucuucgua

SEQ ID NO: 1173 - RNA, 21 nt, Artificial Sequence
  Synthetic construct
cuaccacauauugaccacuua

SEQ ID NO: 1174 - RNA, 21 nt, Artificial Sequence
  Synthetic construct
uccaucaucaugaugcaaaua

SEQ ID NO: 1175 - RNA, 21 nt, Artificial Sequence
  Synthetic construct
caauguccaagauuccaucuu

SEQ ID NO: 1176 - RNA, 21 nt, Artificial Sequence
  Synthetic construct
uuauuaagaagacauguuaac

SEQ ID NO: 1177 - RNA, 21 nt, Artificial Sequence
  Synthetic construct
agaaggacauccauuugagaa

SEQ ID NO: 1178 - RNA, 21 nt, Artificial Sequence
  Synthetic construct
ucagaguacccgaucacuaua

SEQ ID NO: 1179 - RNA, 21 nt, Artificial Sequence
  Synthetic construct
aauacacaaacacuggaguac

SEQ ID NO: 1180 - RNA, 21 nt, Artificial Sequence
  Synthetic construct
cugaaugccuaaugacuccgu

SEQ ID NO: 1181 - RNA, 21 nt, Artificial Sequence
  Synthetic construct
augugaaguucacaauacaaa

SEQ ID NO: 1182 - RNA, 21 nt, Artificial Sequence
  Synthetic construct
agcaaguaaaucuuuauguca

SEQ ID NO: 1183 - RNA, 21 nt, Artificial Sequence
  Synthetic construct
aauuggaauugguauuucagu

SEQ ID NO: 1184 - RNA, 21 nt, Artificial Sequence
  Synthetic construct
aauauuacuugguguaagaua

SEQ ID NO: 1185 - RNA, 21 nt, Artificial Sequence
  Synthetic construct
cuugguguaagauacaguuug

SEQ ID NO: 1186 - RNA, 21 nt, Artificial Sequence
  Synthetic construct
gugauucuugaaagauaccuu

SEQ ID NO: 1187 - RNA, 21 nt, Artificial Sequence
  Synthetic construct
ucaccauugaaauccauaauu

SEQ ID NO: 1188 - RNA, 21 nt, Artificial Sequence
  Synthetic construct
uguaguggucaaugcuggaug

SEQ ID NO: 1189 - RNA, 21 nt, Artificial Sequence
  Synthetic construct
ucuucauuaucacaugauaag

SEQ ID NO: 1190 - RNA, 21 nt, Artificial Sequence
  Synthetic construct
aaguucaaacaaugacuuugu

SEQ ID NO: 1191 - RNA, 21 nt, Artificial Sequence
  Synthetic construct
uauuucaaacuggaagguacu

SEQ ID NO: 1192 - RNA, 21 nt, Artificial Sequence
  Synthetic construct
aagucugaauguaaauuauag

SEQ ID NO: 1193 - RNA, 21 nt, Artificial Sequence
  Synthetic construct
aauguccaagauuccaucuuc

SEQ ID NO: 1194 - RNA, 21 nt, Artificial Sequence
  Synthetic construct
uguuaucuuacgaggacaguc

SEQ ID NO: 1195 - RNA, 21 nt, Artificial Sequence
  Synthetic construct
guguuugagaauagaaaugug

SEQ ID NO: 1196 - RNA, 21 nt, Artificial Sequence
  Synthetic construct
agaccuugugacauauucaaa

SEQ ID NO: 1197 - RNA, 21 nt, Artificial Sequence
  Synthetic construct
agagcuauagcaguaagcaga

SEQ ID NO: 1198 - RNA, 21 nt, Artificial Sequence
  Synthetic construct
aaggguaauuggaauugguau

SEQ ID NO: 1199 - RNA, 21 nt, Artificial Sequence
  Synthetic construct
uccugcucauuuaauuauuuu

SEQ ID NO: 1200 - RNA, 21 nt, Artificial Sequence
  Synthetic construct
cuggaguacaugcaacacauu

SEQ ID NO: 1201 - RNA, 21 nt, Artificial Sequence
  Synthetic construct
acacagacaccgaugagagcu

SEQ ID NO: 1202 - RNA, 21 nt, Artificial Sequence
  Synthetic construct
aucaugaugcaaauaagauua

SEQ ID NO: 1203 - RNA, 21 nt, Artificial Sequence
  Synthetic construct
auuugaauacuuuccaauaau

SEQ ID NO: 1204 - RNA, 21 nt, Artificial Sequence
  Synthetic construct
agauuauaaauacacaaacac

SEQ ID NO: 1205 - RNA, 21 nt, Artificial Sequence
  Synthetic construct
guaguuggagagcuaaaugug

SEQ ID NO: 1206 - RNA, 21 nt, Artificial Sequence
  Synthetic construct
agucagaucaauaaaugcaug

SEQ ID NO: 1207 - RNA, 21 nt, Artificial Sequence
  Synthetic construct
uuucaacuaaucaagugaaca

SEQ ID NO: 1208 - RNA, 21 nt, Artificial Sequence
  Synthetic construct
acuucgagggacauugugagg

SEQ ID NO: 1209 - RNA, 21 nt, Artificial Sequence
  Synthetic construct
uuauuacaagggacguucucc

SEQ ID NO: 1210 - RNA, 21 nt, Artificial Sequence
  Synthetic construct
ugguugcuguucauccacaaa

SEQ ID NO: 1211 - RNA, 21 nt, Artificial Sequence
  Synthetic construct
acauguccauuugcauacuag

SEQ ID NO: 1212 - RNA, 21 nt, Artificial Sequence
  Synthetic construct
acaguuguauacaugauauaa

SEQ ID NO: 1213 - RNA, 21 nt, Artificial Sequence
  Synthetic construct
ugcugccuacagcaguuuccu

SEQ ID NO: 1214 - RNA, 21 nt, Artificial Sequence
  Synthetic construct
auuagauguauaagucuaaua

SEQ ID NO: 1215 - RNA, 21 nt, Artificial Sequence
  Synthetic construct
uucgacgcgccucuucacagc

SEQ ID NO: 1216 - RNA, 21 nt, Artificial Sequence
  Synthetic construct
aaaugcaugagaauguggaau

SEQ ID NO: 1217 - RNA, 21 nt, Artificial Sequence
  Synthetic construct
ucuauaauuagauguauaagu

SEQ ID NO: 1218 - RNA, 21 nt, Artificial Sequence
  Synthetic construct
gacagagaaguuuccauccaa

SEQ ID NO: 1219 - RNA, 21 nt, Artificial Sequence
  Synthetic construct
uacagcaguuuccuuucaaga

SEQ ID NO: 1220 - RNA, 21 nt, Artificial Sequence
  Synthetic construct
cuauugaguauggucauauug

SEQ ID NO: 1221 - RNA, 21 nt, Artificial Sequence
  Synthetic construct
guauaagucuaauaagaucau

SEQ ID NO: 1222 - RNA, 21 nt, Artificial Sequence
  Synthetic construct
cagucauuagaacacagacca

SEQ ID NO: 1223 - RNA, 21 nt, Artificial Sequence
  Synthetic construct
auucaaugucgucaggaauaa

SEQ ID NO: 1224 - RNA, 21 nt, Artificial Sequence
  Synthetic construct
augauauaagguccagguuga

SEQ ID NO: 1225 - RNA, 21 nt, Artificial Sequence
  Synthetic construct
auuaucacaugauaaggauaa

SEQ ID NO: 1226 - RNA, 21 nt, Artificial Sequence
  Synthetic construct
guguucuuuaguaugaccaga

SEQ ID NO: 1227 - RNA, 21 nt, Artificial Sequence
  Synthetic construct
cagagugugcccuuauugcug

SEQ ID NO: 1228 - RNA, 21 nt, Artificial Sequence
  Synthetic construct
aagcuaagcacuucacauaca

SEQ ID NO: 1229 - RNA, 21 nt, Artificial Sequence
  Synthetic construct
cuuuaguaugaccagagcguc

SEQ ID NO: 1230 - RNA, 21 nt, Artificial Sequence
  Synthetic construct
uacgaggacagucauuagaac

SEQ ID NO: 1231 - RNA, 21 nt, Artificial Sequence
  Synthetic construct
auguauaagucuaauaagauc

SEQ ID NO: 1232 - RNA, 21 nt, Artificial Sequence
  Synthetic construct
cauauuguuaggaucuaaugu

SEQ ID NO: 1233 - RNA, 21 nt, Artificial Sequence
  Synthetic construct
augucagaaggacauccauuu

SEQ ID NO: 1234 - RNA, 21 nt, Artificial Sequence
  Synthetic construct
ugugcuaggcaccaagcuaag

SEQ ID NO: 1235 - RNA, 21 nt, Artificial Sequence
  Synthetic construct
auuugcaucauuagaauaaga

SEQ ID NO: 1236 - RNA, 21 nt, Artificial Sequence
  Synthetic construct
caaaggguguuaucuuacgag

SEQ ID NO: 1237 - RNA, 21 nt, Artificial Sequence
  Synthetic construct
agcaguaagcagaacaauauu

SEQ ID NO: 1238 - RNA, 21 nt, Artificial Sequence
  Synthetic construct
agaacaauaacuuuaacaaaa

SEQ ID NO: 1239 - RNA, 21 nt, Artificial Sequence
  Synthetic construct
cauuugagaaucuccaucaua

SEQ ID NO: 1240 - RNA, 21 nt, Artificial Sequence
  Synthetic construct
augcacugugauucuugaaag

SEQ ID NO: 1241 - RNA, 21 nt, Artificial Sequence
  Synthetic construct
acacuggaguacaugcaacac

SEQ ID NO: 1242 - RNA, 21 nt, Artificial Sequence
  Synthetic construct
ccuuauugcugaaaucuugua

SEQ ID NO: 1243 - RNA, 21 nt, Artificial Sequence
  Synthetic construct
augaccagagcgucuggauag

SEQ ID NO: 1244 - RNA, 21 nt, Artificial Sequence
  Synthetic construct
aggccugcugguugcuuccag

SEQ ID NO: 1245 - RNA, 21 nt, Artificial Sequence
  Synthetic construct
agguuuacagagguuaaacaa

SEQ ID NO: 1246 - RNA, 21 nt, Artificial Sequence
  Synthetic construct
aaauuauagacuucuccaagu

SEQ ID NO: 1247 - RNA, 21 nt, Artificial Sequence
  Synthetic construct
agaugcugccuacagcaguuu

SEQ ID NO: 1248 - RNA, 21 nt, Artificial Sequence
  Synthetic construct
ugguuggauucauuugugaua

SEQ ID NO: 1249 - RNA, 21 nt, Artificial Sequence
  Synthetic construct
caugagaauguggaauucgca

SEQ ID NO: 1250 - RNA, 21 nt, Artificial Sequence
  Synthetic construct
guacugacagagaaguuucca

SEQ ID NO: 1251 - RNA, 21 nt, Artificial Sequence
  Synthetic construct
guccagguugauucacuccaa

SEQ ID NO: 1252 - RNA, 21 nt, Artificial Sequence
  Synthetic construct
ccgaccuaaaccaagcacguu

SEQ ID NO: 1253 - RNA, 21 nt, Artificial Sequence
  Synthetic construct
aguuggagagcuaaaugugcg

SEQ ID NO: 1254 - RNA, 21 nt, Artificial Sequence
  Synthetic construct
cauauuguagucuccaauaug

SEQ ID NO: 1255 - RNA, 21 nt, Artificial Sequence
  Synthetic construct
cauuauguaauauuaaaggca

SEQ ID NO: 1256 - RNA, 21 nt, Artificial Sequence
  Synthetic construct
cuacacuuguuaucaaugcac

SEQ ID NO: 1257 - RNA, 21 nt, Artificial Sequence
  Synthetic construct
aaccauauuuauuugaauacu

SEQ ID NO: 1258 - RNA, 21 nt, Artificial Sequence
  Synthetic construct
auauuaaaggcaagucacaua

SEQ ID NO: 1259 - RNA, 21 nt, Artificial Sequence
  Synthetic construct
accaagcuaagcacuucacau

SEQ ID NO: 1260 - RNA, 21 nt, Artificial Sequence
  Synthetic construct
gaaagauaccuuuacuuuggg

SEQ ID NO: 1261 - RNA, 21 nt, Artificial Sequence
  Synthetic construct
uuaaggcaagucugucuuacu

SEQ ID NO: 1262 - RNA, 21 nt, Artificial Sequence
  Synthetic construct
aauuugcaucauuagaauaag

SEQ ID NO: 1263 - RNA, 21 nt, Artificial Sequence
  Synthetic construct
caugauauaagguccagguug

SEQ ID NO: 1264 - RNA, 21 nt, Artificial Sequence
  Synthetic construct
auagcaguaagcagaacaaua

SEQ ID NO: 1265 - RNA, 21 nt, Artificial Sequence
  Synthetic construct
caauaaaugcaugagaaugug

SEQ ID NO: 1266 - RNA, 21 nt, Artificial Sequence
  Synthetic construct
agaaguuuccauccaaauuuu

SEQ ID NO: 1267 - RNA, 21 nt, Artificial Sequence
  Synthetic construct
aagcaucugcuucaaaguuau

SEQ ID NO: 1268 - RNA, 21 nt, Artificial Sequence
  Synthetic construct
cacuuguuaucaaugcacugu

SEQ ID NO: 1269 - RNA, 21 nt, Artificial Sequence
  Synthetic construct
auucgacgcgccucuucacag

SEQ ID NO: 1270 - RNA, 21 nt, Artificial Sequence
  Synthetic construct
aagcugaaugccuaaugacuc

SEQ ID NO: 1271 - RNA, 21 nt, Artificial Sequence
  Synthetic construct
uccauauuguagucuccaaua

SEQ ID NO: 1272 - RNA, 21 nt, Artificial Sequence
  Synthetic construct
auauuaauaaugacaacuacc

SEQ ID NO: 1273 - RNA, 21 nt, Artificial Sequence
  Synthetic construct
cuuuaaacauucgacgcgccu

SEQ ID NO: 1274 - RNA, 21 nt, Artificial Sequence
  Synthetic construct
cuucgagggacauugugaggg

SEQ ID NO: 1275 - RNA, 21 nt, Artificial Sequence
  Synthetic construct
augaagcugaaugccuaauga

SEQ ID NO: 1276 - RNA, 21 nt, Artificial Sequence
  Synthetic construct
gaacccacugcuucaucccag

SEQ ID NO: 1277 - RNA, 21 nt, Artificial Sequence
  Synthetic construct
aaaugugaaguucacaauaca

SEQ ID NO: 1278 - RNA, 21 nt, Artificial Sequence
  Synthetic construct
accgaugagagcuauagcagu

SEQ ID NO: 1279 - RNA, 21 nt, Artificial Sequence
  Synthetic construct
cuuuguauauccuuuacuuag

SEQ ID NO: 1280 - RNA, 21 nt, Artificial Sequence
  Synthetic construct
gucgucaggaauaaaucugcu

SEQ ID NO: 1281 - RNA, 21 nt, Artificial Sequence
  Synthetic construct
agucugcaaaugcugacuguc

SEQ ID NO: 1282 - RNA, 21 nt, Artificial Sequence
  Synthetic construct
uguuaucaaugcacugugauu

SEQ ID NO: 1283 - RNA, 21 nt, Artificial Sequence
  Synthetic construct
auacacaaacacuggaguaca

SEQ ID NO: 1284 - RNA, 21 nt, Artificial Sequence
  Synthetic construct
guuggagagcuaaaugugcgg

SEQ ID NO: 1285 - RNA, 21 nt, Artificial Sequence
  Synthetic construct
auugaagucugaauguaaauu

SEQ ID NO: 1286 - RNA, 21 nt, Artificial Sequence
  Synthetic construct
ccuugugacauauucaaacca

SEQ ID NO: 1287 - RNA, 21 nt, Artificial Sequence
  Synthetic construct
ucagcucccaguagacuuuaa

SEQ ID NO: 1288 - RNA, 21 nt, Artificial Sequence
  Synthetic construct
acagcacuacagaauagagaa

SEQ ID NO: 1289 - RNA, 21 nt, Artificial Sequence
  Synthetic construct
cuacaauguccaagauuccau

SEQ ID NO: 1290 - RNA, 21 nt, Artificial Sequence
  Synthetic construct
acugcuucaucccagaucuca

SEQ ID NO: 1291 - RNA, 21 nt, Artificial Sequence
  Synthetic construct
accacuuacucugugcuaggc

SEQ ID NO: 1292 - RNA, 21 nt, Artificial Sequence
  Synthetic construct
agaauagagaacccaaauuuu

SEQ ID NO: 1293 - RNA, 21 nt, Artificial Sequence
  Synthetic construct
acuaagaacaauaacuuuaac

SEQ ID NO: 1294 - RNA, 21 nt, Artificial Sequence
  Synthetic construct
auugugaggguauggaaugac

SEQ ID NO: 1295 - RNA, 21 nt, Artificial Sequence
  Synthetic construct
acaucauuuauaaauaauauu

SEQ ID NO: 1296 - RNA, 21 nt, Artificial Sequence
  Synthetic construct
uucaaacuggaagguacuagu

SEQ ID NO: 1297 - RNA, 21 nt, Artificial Sequence
  Synthetic construct
acuccaaaggguguuaucuua

SEQ ID NO: 1298 - RNA, 21 nt, Artificial Sequence
  Synthetic construct
ugaggguauggaaugacaauu

SEQ ID NO: 1299 - RNA, 21 nt, Artificial Sequence
  Synthetic construct
acaauguccaagauuccaucu

SEQ ID NO: 1300 - RNA, 21 nt, Artificial Sequence
  Synthetic construct
cuaaguagaugguacucuuuu

SEQ ID NO: 1301 - RNA, 21 nt, Artificial Sequence
  Synthetic construct
ccauuugcaucuacaguugua

SEQ ID NO: 1302 - RNA, 21 nt, Artificial Sequence
  Synthetic construct
aagaagcaagaccaagucaag

SEQ ID NO: 1303 - RNA, 21 nt, Artificial Sequence
  Synthetic construct
agugguugaauuaggaguuua

SEQ ID NO: 1304 - RNA, 21 nt, Artificial Sequence
  Synthetic construct
uauguaauauuaaaggcaagu

SEQ ID NO: 1305 - RNA, 21 nt, Artificial Sequence
  Synthetic construct
aagauuauaaauacacaaaca

SEQ ID NO: 1306 - RNA, 21 nt, Artificial Sequence
  Synthetic construct
aaucucagugaacuauaaaga

SEQ ID NO: 1307 - RNA, 21 nt, Artificial Sequence
  Synthetic construct
caacuaccacauauugaccac

SEQ ID NO: 1308 - RNA, 21 nt, Artificial Sequence
  Synthetic construct
acaagggacguucuccaguaa

SEQ ID NO: 1309 - RNA, 21 nt, Artificial Sequence
  Synthetic construct
ugacuccgugauauauucaca

SEQ ID NO: 1310 - RNA, 21 nt, Artificial Sequence
  Synthetic construct
cuaccaagucagaguacccga

SEQ ID NO: 1311 - RNA, 21 nt, Artificial Sequence
  Synthetic construct
augaaaccggugggcuucuug

SEQ ID NO: 1312 - RNA, 21 nt, Artificial Sequence
  Synthetic construct
ugugaaguucacaauacaaaa

SEQ ID NO: 1313 - RNA, 21 nt, Artificial Sequence
  Synthetic construct
acuggaagguacuaguggugg

SEQ ID NO: 1314 - RNA, 21 nt, Artificial Sequence
  Synthetic construct
uauuaagaagacauguuaaca

SEQ ID NO: 1315 - RNA, 21 nt, Artificial Sequence
  Synthetic construct
ucuucacagcuugcauuauua

SEQ ID NO: 1316 - RNA, 21 nt, Artificial Sequence
  Synthetic construct
acauguuaacaugcuuagaua

SEQ ID NO: 1317 - RNA, 21 nt, Artificial Sequence
  Synthetic construct
aagauaugucagaaggacauc

SEQ ID NO: 1318 - RNA, 21 nt, Artificial Sequence
  Synthetic construct
guuuaaggcaagucugucuua

SEQ ID NO: 1319 - RNA, 21 nt, Artificial Sequence
  Synthetic construct
auuccugcucauuuaauuauu

SEQ ID NO: 1320 - RNA, 21 nt, Artificial Sequence
  Synthetic construct
gaagacauguuaacaugcuua

SEQ ID NO: 1321 - RNA, 21 nt, Artificial Sequence
  Synthetic construct
aauaugaaggguaauuggaau

SEQ ID NO: 1322 - RNA, 21 nt, Artificial Sequence
  Synthetic construct
caaaugcugacuguccaacca

SEQ ID NO: 1323 - RNA, 21 nt, Artificial Sequence
  Synthetic construct
uauauacaaagugcuuuaaaa

SEQ ID NO: 1324 - RNA, 21 nt, Artificial Sequence
  Synthetic construct
uaaugacuccgugauauauuc

SEQ ID NO: 1325 - RNA, 21 nt, Artificial Sequence
  Synthetic construct
gucauuagaacacagaccacu

SEQ ID NO: 1326 - RNA, 21 nt, Artificial Sequence
  Synthetic construct
aucccauuuaauguuuacagu

SEQ ID NO: 1327 - RNA, 21 nt, Artificial Sequence
  Synthetic construct
acaucaucccauuuaauguuu

SEQ ID NO: 1328 - RNA, 21 nt, Artificial Sequence
  Synthetic construct
auaccuuuacuuuggguuuaa

SEQ ID NO: 1329 - RNA, 21 nt, Artificial Sequence
  Synthetic construct
gaauauuucuucaugccugaa

SEQ ID NO: 1330 - RNA, 21 nt, Artificial Sequence
  Synthetic construct
gucugucuuacugugcuacca

SEQ ID NO: 1331 - RNA, 21 nt, Artificial Sequence
  Synthetic construct
aguguuugagaauagaaaugu

SEQ ID NO: 1332 - RNA, 21 nt, Artificial Sequence
  Synthetic construct
aucaucaugaugcaaauaaga

SEQ ID NO: 1333 - RNA, 21 nt, Artificial Sequence
  Synthetic construct
guaacucaaguauuagcccca

SEQ ID NO: 1334 - RNA, 21 nt, Artificial Sequence
  Synthetic construct
guuguauacaugauauaaggu

SEQ ID NO: 1335 - RNA, 21 nt, Artificial Sequence
  Synthetic construct
ucucacuaaguagaugguacu

SEQ ID NO: 1336 - RNA, 21 nt, Artificial Sequence
  Synthetic construct
ugaugaagcugaaugccuaau

SEQ ID NO: 1337 - RNA, 21 nt, Artificial Sequence
  Synthetic construct
ugcgcuccgaccuaaaccaag

SEQ ID NO: 1338 - RNA, 21 nt, Artificial Sequence
  Synthetic construct
cagcuugcauuauuacaaggg

SEQ ID NO: 1339 - RNA, 21 nt, Artificial Sequence
  Synthetic construct
uggaacccacugcuucauccc

SEQ ID NO: 1340 - RNA, 21 nt, Artificial Sequence
  Synthetic construct
auaagucuaauaagaucaucu

SEQ ID NO: 1341 - RNA, 21 nt, Artificial Sequence
  Synthetic construct
aaaggguguuaucuuacgagg

SEQ ID NO: 1342 - RNA, 21 nt, Artificial Sequence
  Synthetic construct
aacguagagauggucaagaaa

SEQ ID NO: 1343 - RNA, 21 nt, Artificial Sequence
  Synthetic construct
aggguauggaaugacaauuag

SEQ ID NO: 1344 - RNA, 21 nt, Artificial Sequence
  Synthetic construct
auuagcugggaauuuggaaug

SEQ ID NO: 1345 - RNA, 21 nt, Artificial Sequence
  Synthetic construct
acuucuccaaguguuugagaa

SEQ ID NO: 1346 - RNA, 21 nt, Artificial Sequence
  Synthetic construct
ucagugaacuauaaagaaaaa

SEQ ID NO: 1347 - RNA, 21 nt, Artificial Sequence
  Synthetic construct
ucuucagucagaucaauaaau

SEQ ID NO: 1348 - RNA, 21 nt, Artificial Sequence
  Synthetic construct
ugguugaauuaggaguuuaag

SEQ ID NO: 1349 - RNA, 21 nt, Artificial Sequence
  Synthetic construct
augggauacaucauuuauaaa

SEQ ID NO: 1350 - RNA, 21 nt, Artificial Sequence
  Synthetic construct
ccuuaauuugauuuaggucug

SEQ ID NO: 1351 - RNA, 21 nt, Artificial Sequence
  Synthetic construct
aucaauaaaugcaugagaaug

SEQ ID NO: 1352 - RNA, 21 nt, Artificial Sequence
  Synthetic construct
auuugagaaucuccaucauaa

SEQ ID NO: 1353 - RNA, 21 nt, Artificial Sequence
  Synthetic construct
uuagcacuacaauguccaaga

SEQ ID NO: 1354 - RNA, 21 nt, Artificial Sequence
  Synthetic construct
agagugugcccuuauugcuga

SEQ ID NO: 1355 - RNA, 21 nt, Artificial Sequence
  Synthetic construct
ucccauauuucaaacuggaag

SEQ ID NO: 1356 - RNA, 21 nt, Artificial Sequence
  Synthetic construct
gacuuuaaacauucgacgcgc

SEQ ID NO: 1357 - RNA, 21 nt, Artificial Sequence
  Synthetic construct
gauugcaguccacucuuguuu

SEQ ID NO: 1358 - RNA, 21 nt, Artificial Sequence
  Synthetic construct
guccaucuccaucaaagucug

SEQ ID NO: 1359 - RNA, 21 nt, Artificial Sequence
  Synthetic construct
acuuuaaacauucgacgcgcc

SEQ ID NO: 1360 - RNA, 21 nt, Artificial Sequence
  Synthetic construct
cugugcuaccaagucagagua

SEQ ID NO: 1361 - RNA, 21 nt, Artificial Sequence
  Synthetic construct
uccuauugaguauggucauau

SEQ ID NO: 1362 - RNA, 21 nt, Artificial Sequence
  Synthetic construct
aguauaauuugcaucauuaga

SEQ ID NO: 1363 - RNA, 21 nt, Artificial Sequence
  Synthetic construct
accaacguagagauggucaag

SEQ ID NO: 1364 - RNA, 21 nt, Artificial Sequence
  Synthetic construct
acauucgacgcgccucuucac

SEQ ID NO: 1365 - RNA, 21 nt, Artificial Sequence
  Synthetic construct
caguugguugcuguucaucca

SEQ ID NO: 1366 - RNA, 21 nt, Artificial Sequence
  Synthetic construct
cugucuuacugugcuaccaag

SEQ ID NO: 1367 - RNA, 21 nt, Artificial Sequence
  Synthetic construct
augcaacacauuccacaaagg

SEQ ID NO: 1368 - RNA, 21 nt, Artificial Sequence
  Synthetic construct
aggacuggaacccacugcuuc

SEQ ID NO: 1369 - RNA, 21 nt, Artificial Sequence
  Synthetic construct
ucuccaaguguuugagaauag

SEQ ID NO: 1370 - RNA, 21 nt, Artificial Sequence
  Synthetic construct
ugcuucaucccagaucucacu

SEQ ID NO: 1371 - RNA, 21 nt, Artificial Sequence
  Synthetic construct
aauauuucuucaugccugaaa

SEQ ID NO: 1372 - RNA, 21 nt, Artificial Sequence
  Synthetic construct
agaaaucaaauguucuucauu

SEQ ID NO: 1373 - RNA, 21 nt, Artificial Sequence
  Synthetic construct
ucuccaucaaagucugcaaau

SEQ ID NO: 1374 - RNA, 21 nt, Artificial Sequence
  Synthetic construct
ucaauaaaugcaugagaaugu

SEQ ID NO: 1375 - RNA, 21 nt, Artificial Sequence
  Synthetic construct
aucacaugauaaggauaaguu

SEQ ID NO: 1376 - RNA, 21 nt, Artificial Sequence
  Synthetic construct
acagucauuagaacacagacc

SEQ ID NO: 1377 - RNA, 21 nt, Artificial Sequence
  Synthetic construct
ucugucagcucccaguagacu

SEQ ID NO: 1378 - RNA, 21 nt, Artificial Sequence
  Synthetic construct
cauugaaauccauaauuagug

SEQ ID NO: 1379 - RNA, 21 nt, Artificial Sequence
  Synthetic construct
cuuuguaagugguugaauuag

SEQ ID NO: 1380 - RNA, 21 nt, Artificial Sequence
  Synthetic construct
aaggcaagucacauagcauca

SEQ ID NO: 1381 - RNA, 21 nt, Artificial Sequence
  Synthetic construct
acuuuguaagugguugaauua

SEQ ID NO: 1382 - RNA, 21 nt, Artificial Sequence
  Synthetic construct
aaauaagauuauaaauacaca

SEQ ID NO: 1383 - RNA, 21 nt, Artificial Sequence
  Synthetic construct
auacaucaucccauuuaaugu

SEQ ID NO: 1384 - RNA, 21 nt, Artificial Sequence
  Synthetic construct
uaagguccagguugauucacu

SEQ ID NO: 1385 - RNA, 21 nt, Artificial Sequence
  Synthetic construct
gaccacuaagaacaauaacuu

SEQ ID NO: 1386 - RNA, 21 nt, Artificial Sequence
  Synthetic construct
cugugaugaagcugaaugccu

SEQ ID NO: 1387 - RNA, 21 nt, Artificial Sequence
  Synthetic construct
ugcuaggcaccaagcuaagca

SEQ ID NO: 1388 - RNA, 21 nt, Artificial Sequence
  Synthetic construct
guacccgaucacuauauugua

SEQ ID NO: 1389 - RNA, 21 nt, Artificial Sequence
  Synthetic construct
caccgaugagagcuauagcag

SEQ ID NO: 1390 - RNA, 21 nt, Artificial Sequence
  Synthetic construct
ucccagaugcugccuacagca

SEQ ID NO: 1391 - RNA, 21 nt, Artificial Sequence
  Synthetic construct
cagucagaucaauaaaugcau

SEQ ID NO: 1392 - RNA, 21 nt, Artificial Sequence
  Synthetic construct
augcaugagaauguggaauuc

SEQ ID NO: 1393 - RNA, 21 nt, Artificial Sequence
  Synthetic construct
uguauacaugauauaaggucc

SEQ ID NO: 1394 - RNA, 21 nt, Artificial Sequence
  Synthetic construct
uccaauaauuaccaugggaua

SEQ ID NO: 1395 - RNA, 21 nt, Artificial Sequence
  Synthetic construct
caauauuacuugguguaagau

SEQ ID NO: 1396 - RNA, 21 nt, Artificial Sequence
  Synthetic construct
aaaggcaagucacauagcauc

SEQ ID NO: 1397 - RNA, 21 nt, Artificial Sequence
  Synthetic construct
auugguauuucaguugguugc

SEQ ID NO: 1398 - RNA, 21 nt, Artificial Sequence
  Synthetic construct
uccuuucaagaaaucaaaugu

SEQ ID NO: 1399 - RNA, 21 nt, Artificial Sequence
  Synthetic construct
guauuucuauaauuagaugua

SEQ ID NO: 1400 - RNA, 21 nt, Artificial Sequence
  Synthetic construct
uccauuauguaauauuaaagg

SEQ ID NO: 1401 - RNA, 21 nt, Artificial Sequence
  Synthetic construct
aacacuggaguacaugcaaca

SEQ ID NO: 1402 - RNA, 21 nt, Artificial Sequence
  Synthetic construct
aagauuugcauucccagaugc

SEQ ID NO: 1403 - RNA, 21 nt, Artificial Sequence
  Synthetic construct
guagacuuuaaacauucgacg

SEQ ID NO: 1404 - RNA, 21 nt, Artificial Sequence
  Synthetic construct
ccacuaagaacaauaacuuua

SEQ ID NO: 1405 - RNA, 21 nt, Artificial Sequence
  Synthetic construct
gauucuugaaagauaccuuua

SEQ ID NO: 1406 - RNA, 21 nt, Artificial Sequence
  Synthetic construct
caauuagcugggaauuuggaa

SEQ ID NO: 1407 - RNA, 21 nt, Artificial Sequence
  Synthetic construct
agucuauguauuucuauaauu

SEQ ID NO: 1408 - RNA, 21 nt, Artificial Sequence
  Synthetic construct
cacguuguaugguaguuggag

SEQ ID NO: 1409 - RNA, 21 nt, Artificial Sequence
  Synthetic construct
ugccuaaugacuccgugauau

SEQ ID NO: 1410 - RNA, 21 nt, Artificial Sequence
  Synthetic construct
ugaaaccggugggcuucuugu

SEQ ID NO: 1411 - RNA, 21 nt, Artificial Sequence
  Synthetic construct
guugauucacuccaaagggug

SEQ ID NO: 1412 - RNA, 21 nt, Artificial Sequence
  Synthetic construct
aauuagaucaccauugaaauc

SEQ ID NO: 1413 - RNA, 21 nt, Artificial Sequence
  Synthetic construct
ugauaaauucccuccuaauag

SEQ ID NO: 1414 - RNA, 21 nt, Artificial Sequence
  Synthetic construct
auucacuccaaaggguguuau

SEQ ID NO: 1415 - RNA, 21 nt, Artificial Sequence
  Synthetic construct
ugaauacuuuccaauaauuac

SEQ ID NO: 1416 - RNA, 21 nt, Artificial Sequence
  Synthetic construct
aaugcugacuguccaaccacc

SEQ ID NO: 1417 - RNA, 21 nt, Artificial Sequence
  Synthetic construct
aaugcacugugauucuugaaa

SEQ ID NO: 1418 - RNA, 21 nt, Artificial Sequence
  Synthetic construct
gaauugguauuucaguugguu

SEQ ID NO: 1419 - RNA, 21 nt, Artificial Sequence
  Synthetic construct
auaauuaccaugggauacauc

SEQ ID NO: 1420 - RNA, 21 nt, Artificial Sequence
  Synthetic construct
agaucaauaaaugcaugagaa

SEQ ID NO: 1421 - RNA, 21 nt, Artificial Sequence
  Synthetic construct
gcugaaaucuuguaggacugg

SEQ ID NO: 1422 - RNA, 21 nt, Artificial Sequence
  Synthetic construct
auucauuugugauaccaaaaa

SEQ ID NO: 1423 - RNA, 21 nt, Artificial Sequence
  Synthetic construct
guucaaacaaugacuuuguaa

SEQ ID NO: 1424 - RNA, 21 nt, Artificial Sequence
  Synthetic construct
auuccauuauguaauauuaaa

SEQ ID NO: 1425 - RNA, 21 nt, Artificial Sequence
  Synthetic construct
guacaugcaacacauuccaca

SEQ ID NO: 1426 - RNA, 21 nt, Artificial Sequence
  Synthetic construct
auucccagaugcugccuacag

SEQ ID NO: 1427 - RNA, 21 nt, Artificial Sequence
  Synthetic construct
agucugaauguaaauuauaga

SEQ ID NO: 1428 - RNA, 21 nt, Artificial Sequence
  Synthetic construct
cacagcuugcauuauuacaag

SEQ ID NO: 1429 - RNA, 21 nt, Artificial Sequence
  Synthetic construct
caauaugaaggguaauuggaa

SEQ ID NO: 1430 - RNA, 21 nt, Artificial Sequence
  Synthetic construct
caucuccaucaaagucugcaa

SEQ ID NO: 1431 - RNA, 21 nt, Artificial Sequence
  Synthetic construct
agucuaauaagaucaucuaaa

SEQ ID NO: 1432 - RNA, 21 nt, Artificial Sequence
  Synthetic construct
ugcugugaugaagcugaaugc

SEQ ID NO: 1433 - RNA, 21 nt, Artificial Sequence
  Synthetic construct
cuuuacuuagcacuacaaugu

SEQ ID NO: 1434 - RNA, 21 nt, Artificial Sequence
  Synthetic construct
auguuaacaugcuuagauaca

SEQ ID NO: 1435 - RNA, 21 nt, Artificial Sequence
  Synthetic construct
ugcuuagauacaaaguaaaaa

SEQ ID NO: 1436 - RNA, 21 nt, Artificial Sequence
  Synthetic construct
auggucauauuguuaggaucu

SEQ ID NO: 1437 - RNA, 21 nt, Artificial Sequence
  Synthetic construct
aacauucgacgcgccucuuca

SEQ ID NO: 1438 - RNA, 21 nt, Artificial Sequence
  Synthetic construct
uaccuuuacuuuggguuuaaa

SEQ ID NO: 1439 - RNA, 21 nt, Artificial Sequence
  Synthetic construct
gugaugaagcugaaugccuaa

SEQ ID NO: 1440 - RNA, 21 nt, Artificial Sequence
  Synthetic construct
agggcacauuaauucuuggag

SEQ ID NO: 1441 - RNA, 21 nt, Artificial Sequence
  Synthetic construct
acagcaguuuccuuucaagaa

SEQ ID NO: 1442 - RNA, 21 nt, Artificial Sequence
  Synthetic construct
augcuuagauacaaaguaaaa

SEQ ID NO: 1443 - RNA, 21 nt, Artificial Sequence
  Synthetic construct
acuccgugauauauucacaaa

SEQ ID NO: 1444 - RNA, 21 nt, Artificial Sequence
  Synthetic construct
ucuuuaugucaaucaccaaaa

SEQ ID NO: 1445 - RNA, 21 nt, Artificial Sequence
  Synthetic construct
gauugaagauuugcauuccca

SEQ ID NO: 1446 - RNA, 21 nt, Artificial Sequence
  Synthetic construct
auuaggaguuuaaggcaaguc

SEQ ID NO: 1447 - RNA, 21 nt, Artificial Sequence
  Synthetic construct
aauuuggaaugauugcagucc

SEQ ID NO: 1448 - RNA, 21 nt, Artificial Sequence
  Synthetic construct
ucccagaucucacuaaguaga

SEQ ID NO: 1449 - RNA, 21 nt, Artificial Sequence
  Synthetic construct
cacuaaguagaugguacucuu

SEQ ID NO: 1450 - RNA, 21 nt, Artificial Sequence
  Synthetic construct
ugcaucauuagaauaagaagc

SEQ ID NO: 1451 - RNA, 21 nt, Artificial Sequence
  Synthetic construct
agauguauaagucuaauaaga

SEQ ID NO: 1452 - RNA, 21 nt, Artificial Sequence
  Synthetic construct
uugugaggguauggaaugaca

SEQ ID NO: 1453 - RNA, 21 nt, Artificial Sequence
  Synthetic construct
agucagaguacccgaucacua

SEQ ID NO: 1454 - RNA, 21 nt, Artificial Sequence
  Synthetic construct
cugugcuaggcaccaagcuaa

SEQ ID NO: 1455 - RNA, 21 nt, Artificial Sequence
  Synthetic construct
guauaauuugcaucauuagaa

SEQ ID NO: 1456 - RNA, 21 nt, Artificial Sequence
  Synthetic construct
uaauuaccaugggauacauca

SEQ ID NO: 1457 - RNA, 21 nt, Artificial Sequence
  Synthetic construct
cacauuaauucuuggagagua

SEQ ID NO: 1458 - RNA, 21 nt, Artificial Sequence
  Synthetic construct
cuugaaagauaccuuuacuuu

SEQ ID NO: 1459 - RNA, 21 nt, Artificial Sequence
  Synthetic construct
cugccuacagcaguuuccuuu

SEQ ID NO: 1460 - RNA, 21 nt, Artificial Sequence
  Synthetic construct
aagaccaagucaaguggacac

SEQ ID NO: 1461 - RNA, 21 nt, Artificial Sequence
  Synthetic construct
ggaauugguauuucaguuggu

SEQ ID NO: 1462 - RNA, 21 nt, Artificial Sequence
  Synthetic construct
ccauauuucaaacuggaaggu

SEQ ID NO: 1463 - RNA, 21 nt, Artificial Sequence
  Synthetic construct
gaacaauauuacuugguguaa

SEQ ID NO: 1464 - RNA, 21 nt, Artificial Sequence
  Synthetic construct
caagucuauguauuucuauaa

SEQ ID NO: 1465 - RNA, 21 nt, Artificial Sequence
  Synthetic construct
aagauuccaucuucguaaaug

SEQ ID NO: 1466 - RNA, 21 nt, Artificial Sequence
  Synthetic construct
acaugauaaggauaaguuuuu

SEQ ID NO: 1467 - RNA, 21 nt, Artificial Sequence
  Synthetic construct
acauacaucaucccauuuaau

SEQ ID NO: 1468 - RNA, 21 nt, Artificial Sequence
  Synthetic construct
gacauguuaacaugcuuagau

SEQ ID NO: 1469 - RNA, 21 nt, Artificial Sequence
  Synthetic construct
ugguaguuggagagcuaaaug

SEQ ID NO: 1470 - RNA, 21 nt, Artificial Sequence
  Synthetic construct
cuauagcaguaagcagaacaa

SEQ ID NO: 1471 - RNA, 21 nt, Artificial Sequence
  Synthetic construct
cuucaucccagaucucacuaa

SEQ ID NO: 1472 - RNA, 21 nt, Artificial Sequence
  Synthetic construct
cucugugcuaggcaccaagcu

SEQ ID NO: 1473 - RNA, 21 nt, Artificial Sequence
  Synthetic construct
aagguccagguugauucacuc

SEQ ID NO: 1474 - RNA, 21 nt, Artificial Sequence
  Synthetic construct
gacuggaacccacugcuucau

SEQ ID NO: 1475 - RNA, 21 nt, Artificial Sequence
  Synthetic construct
aucacauguccauuugcauac

SEQ ID NO: 1476 - RNA, 21 nt, Artificial Sequence
  Synthetic construct
cuacagaauagagaacccaaa

SEQ ID NO: 1477 - RNA, 21 nt, Artificial Sequence
  Synthetic construct
aaugacaauuagcugggaauu

SEQ ID NO: 1478 - RNA, 21 nt, Artificial Sequence
  Synthetic construct
guaaaucuuuaugucaaucac

SEQ ID NO: 1479 - RNA, 21 nt, Artificial Sequence
  Synthetic construct
guaugguaguuggagagcuaa

SEQ ID NO: 1480 - RNA, 21 nt, Artificial Sequence
  Synthetic construct
cauccuuaauuugauuuaggu

SEQ ID NO: 1481 - RNA, 21 nt, Artificial Sequence
  Synthetic construct
aucuuacgaggacagucauua

SEQ ID NO: 1482 - RNA, 21 nt, Artificial Sequence
  Synthetic construct
cacaugauaaggauaaguuuu

SEQ ID NO: 1483 - RNA, 21 nt, Artificial Sequence
  Synthetic construct
uuaacagugaugacuucccug

SEQ ID NO: 1484 - RNA, 21 nt, Artificial Sequence
  Synthetic construct
uugacaaauacacaguucgaa

SEQ ID NO: 1485 - RNA, 21 nt, Artificial Sequence
  Synthetic construct
uuaagaucuagcuucucgguu

SEQ ID NO: 1486 - RNA, 21 nt, Artificial Sequence
  Synthetic construct
uaacacuuuaugauugcucuu

SEQ ID NO: 1487 - RNA, 21 nt, Artificial Sequence
  Synthetic construct
uucacuuuccucauuauccuu

SEQ ID NO: 1488 - RNA, 21 nt, Artificial Sequence
  Synthetic construct
uucaauaucagaaucugacuu

SEQ ID NO: 1489 - RNA, 21 nt, Artificial Sequence
  Synthetic construct
uuaaaccugaauaaauuccua

SEQ ID NO: 1490 - RNA, 21 nt, Artificial Sequence
  Synthetic construct
uagaauaccaauagagaucuu

SEQ ID NO: 1491 - RNA, 21 nt, Artificial Sequence
  Synthetic construct
ugcacugagaggaucguccag

SEQ ID NO: 1492 - RNA, 21 nt, Artificial Sequence
  Synthetic construct
ucaucuuccucuaaucuccgu

SEQ ID NO: 1493 - RNA, 21 nt, Artificial Sequence
  Synthetic construct
uauaacuucauucaugguccu

SEQ ID NO: 1494 - RNA, 21 nt, Artificial Sequence
  Synthetic construct
uuugacaaauacacaguucga

SEQ ID NO: 1495 - RNA, 21 nt, Artificial Sequence
  Synthetic construct
auaacuucauucaugguccug

SEQ ID NO: 1496 - RNA, 21 nt, Artificial Sequence
  Synthetic construct
uuaaagaaggcuucugugcgu

SEQ ID NO: 1497 - RNA, 21 nt, Artificial Sequence
  Synthetic construct
uguaagaacacugucaccuga

SEQ ID NO: 1498 - RNA, 21 nt, Artificial Sequence
  Synthetic construct
uaagauuuccaguaacacuuu

SEQ ID NO: 1499 - RNA, 21 nt, Artificial Sequence
  Synthetic construct
ucauucaugguccugauccug

SEQ ID NO: 1500 - RNA, 21 nt, Artificial Sequence
  Synthetic construct
ucagaaucugacuugcagcuu

SEQ ID NO: 1501 - RNA, 21 nt, Artificial Sequence
  Synthetic construct
uacacgggcagcaucuugccg

SEQ ID NO: 1502 - RNA, 21 nt, Artificial Sequence
  Synthetic construct
auacauaucaucuuccucuaa

SEQ ID NO: 1503 - RNA, 21 nt, Artificial Sequence
  Synthetic construct
ugaagaguuaacaaggacgua

SEQ ID NO: 1504 - RNA, 21 nt, Artificial Sequence
  Synthetic construct
uuugugaagaguuaacaagga

SEQ ID NO: 1505 - RNA, 21 nt, Artificial Sequence
  Synthetic construct
ucuaucaaagaauaauaccgg

SEQ ID NO: 1506 - RNA, 21 nt, Artificial Sequence
  Synthetic construct
ugauaucucaucaaguagcaa

SEQ ID NO: 1507 - RNA, 21 nt, Artificial Sequence
  Synthetic construct
ugacauuuagcauacuuuguu

SEQ ID NO: 1508 - RNA, 21 nt, Artificial Sequence
  Synthetic construct
aaacuuguucacaucauugga

SEQ ID NO: 1509 - RNA, 21 nt, Artificial Sequence
  Synthetic construct
uuuacagugacauuuagcaua

SEQ ID NO: 1510 - RNA, 21 nt, Artificial Sequence
  Synthetic construct
auuuacagugacauuuagcau

SEQ ID NO: 1511 - RNA, 21 nt, Artificial Sequence
  Synthetic construct
aagcacauaggcaacaucuug

SEQ ID NO: 1512 - RNA, 21 nt, Artificial Sequence
  Synthetic construct
uucucgguuacauuuccuccu

SEQ ID NO: 1513 - RNA, 21 nt, Artificial Sequence
  Synthetic construct
uaaaccugaauaaauuccuaa

SEQ ID NO: 1514 - RNA, 21 nt, Artificial Sequence
  Synthetic construct
aaucuuggaaaucuccuucuu

SEQ ID NO: 1515 - RNA, 21 nt, Artificial Sequence
  Synthetic construct
uauuacuccucagaguucccg

SEQ ID NO: 1516 - RNA, 21 nt, Artificial Sequence
  Synthetic construct
uuccuauuggauuucuaucaa

SEQ ID NO: 1517 - RNA, 21 nt, Artificial Sequence
  Synthetic construct
auaccaauagagaucuugcua

SEQ ID NO: 1518 - RNA, 21 nt, Artificial Sequence
  Synthetic construct
uuuccaguaacacuuuaugau

SEQ ID NO: 1519 - RNA, 21 nt, Artificial Sequence
  Synthetic construct
uugcucuuguuaaagaaggcu

SEQ ID NO: 1520 - RNA, 21 nt, Artificial Sequence
  Synthetic construct
uaucaaagaauaauaccggag

SEQ ID NO: 1521 - RNA, 21 nt, Artificial Sequence
  Synthetic construct
ugagguacugcaacugaugag

SEQ ID NO: 1522 - RNA, 21 nt, Artificial Sequence
  Synthetic construct
uuccgcaucuacugcacugag

SEQ ID NO: 1523 - RNA, 21 nt, Artificial Sequence
  Synthetic construct
ugaauacauaucaucuuccuc

SEQ ID NO: 1524 - RNA, 21 nt, Artificial Sequence
  Synthetic construct
aucaccauccuccaacagcug

SEQ ID NO: 1525 - RNA, 21 nt, Artificial Sequence
  Synthetic construct
uugcaacuccucuccaaggug

SEQ ID NO: 1526 - RNA, 21 nt, Artificial Sequence
  Synthetic construct
uuguuaaagaaggcuucugug

SEQ ID NO: 1527 - RNA, 21 nt, Artificial Sequence
  Synthetic construct
ucuugauacacugcucuugca

SEQ ID NO: 1528 - RNA, 21 nt, Artificial Sequence
  Synthetic construct
uuucagaauugacucaaacau

SEQ ID NO: 1529 - RNA, 21 nt, Artificial Sequence
  Synthetic construct
agugaugagaacaacuuccca

SEQ ID NO: 1530 - RNA, 21 nt, Artificial Sequence
  Synthetic construct
ucaauaucagaaucugacuug

SEQ ID NO: 1531 - RNA, 21 nt, Artificial Sequence
  Synthetic construct
aaucuugaagcacauaggcaa

SEQ ID NO: 1532 - RNA, 21 nt, Artificial Sequence
  Synthetic construct
ucuuccaugcacgcugaccag

SEQ ID NO: 1533 - RNA, 21 nt, Artificial Sequence
  Synthetic construct
aagauuuccaguaacacuuua

SEQ ID NO: 1534 - RNA, 21 nt, Artificial Sequence
  Synthetic construct
uacugcacugagaggaucguc

SEQ ID NO: 1535 - RNA, 21 nt, Artificial Sequence
  Synthetic construct
uaagaucuagcuucucgguua

SEQ ID NO: 1536 - RNA, 21 nt, Artificial Sequence
  Synthetic construct
uuagugugggaguuccuggaa

SEQ ID NO: 1537 - RNA, 21 nt, Artificial Sequence
  Synthetic construct
aacacuuuaugauugcucuug

SEQ ID NO: 1538 - RNA, 21 nt, Artificial Sequence
  Synthetic construct
uacacugcucuugcaagguuu

SEQ ID NO: 1539 - RNA, 21 nt, Artificial Sequence
  Synthetic construct
auaucagaaucugacuugcag

SEQ ID NO: 1540 - RNA, 21 nt, Artificial Sequence
  Synthetic construct
auagagaucuugcuaugccaa

SEQ ID NO: 1541 - RNA, 21 nt, Artificial Sequence
  Synthetic construct
aauacauaucaucuuccucua

SEQ ID NO: 1542 - RNA, 21 nt, Artificial Sequence
  Synthetic construct
uacacaguucgaacaaguguc

SEQ ID NO: 1543 - RNA, 21 nt, Artificial Sequence
  Synthetic construct
uauuggauuucuaucaaagaa

SEQ ID NO: 1544 - RNA, 21 nt, Artificial Sequence
  Synthetic construct
aucaucuuccucuaaucuccg

SEQ ID NO: 1545 - RNA, 21 nt, Artificial Sequence
  Synthetic construct
uagaagauuguugagaccaaa

SEQ ID NO: 1546 - RNA, 21 nt, Artificial Sequence
  Synthetic construct
uaccaauagagaucuugcuau

SEQ ID NO: 1547 - RNA, 21 nt, Artificial Sequence
  Synthetic construct
uugugaagaguuaacaaggac

SEQ ID NO: 1548 - RNA, 21 nt, Artificial Sequence
  Synthetic construct
ugcucuugcaagguuuacccg

SEQ ID NO: 1549 - RNA, 21 nt, Artificial Sequence
  Synthetic construct
auacuuuguuuguuugcccag

SEQ ID NO: 1550 - RNA, 21 nt, Artificial Sequence
  Synthetic construct
uuauaccaguuauaacuucau

SEQ ID NO: 1551 - RNA, 21 nt, Artificial Sequence
  Synthetic construct
uaaauuccuaaguaccaguua

SEQ ID NO: 1552 - RNA, 21 nt, Artificial Sequence
  Synthetic construct
uugccucugacacccucucaa

SEQ ID NO: 1553 - RNA, 21 nt, Artificial Sequence
  Synthetic construct
uaacuuccgcaucuacugcac

SEQ ID NO: 1554 - RNA, 21 nt, Artificial Sequence
  Synthetic construct
uauuccuaucuccauccagag

SEQ ID NO: 1555 - RNA, 21 nt, Artificial Sequence
  Synthetic construct
auacacaguucgaacaagugu

SEQ ID NO: 1556 - RNA, 21 nt, Artificial Sequence
  Synthetic construct
uuacuccucagaguucccgag

SEQ ID NO: 1557 - RNA, 21 nt, Artificial Sequence
  Synthetic construct
aacaaggacguagaauaccaa

SEQ ID NO: 1558 - RNA, 21 nt, Artificial Sequence
  Synthetic construct
uuuagcauacuuuguuuguuu

SEQ ID NO: 1559 - RNA, 21 nt, Artificial Sequence
  Synthetic construct
ucagcaucuugauacacugcu

SEQ ID NO: 1560 - RNA, 21 nt, Artificial Sequence
  Synthetic construct
ugcagcuuugagguacugcaa

SEQ ID NO: 1561 - RNA, 21 nt, Artificial Sequence
  Synthetic construct
agauuguugagaccaaaccga

SEQ ID NO: 1562 - RNA, 21 nt, Artificial Sequence
  Synthetic construct
uugagguacugcaacugauga

SEQ ID NO: 1563 - RNA, 21 nt, Artificial Sequence
  Synthetic construct
uauaccaguuauaacuucauu

SEQ ID NO: 1564 - RNA, 21 nt, Artificial Sequence
  Synthetic construct
uuagcauacuuuguuuguuug

SEQ ID NO: 1565 - RNA, 21 nt, Artificial Sequence
  Synthetic construct
uucuuuaucccagaacccuug

SEQ ID NO: 1566 - RNA, 21 nt, Artificial Sequence
  Synthetic construct
aauaccaauagagaucuugcu

SEQ ID NO: 1567 - RNA, 21 nt, Artificial Sequence
  Synthetic construct
uucagaauugacucaaacauu

SEQ ID NO: 1568 - RNA, 21 nt, Artificial Sequence
  Synthetic construct
ucugaggcaggaacuucucag

SEQ ID NO: 1569 - RNA, 21 nt, Artificial Sequence
  Synthetic construct
ugucaccugaucaaacuuguu

SEQ ID NO: 1570 - RNA, 21 nt, Artificial Sequence
  Synthetic construct
ucuuucaauaucagaaucuga

SEQ ID NO: 1571 - RNA, 21 nt, Artificial Sequence
  Synthetic construct
uuggaaaucuccuucuuucuc

SEQ ID NO: 1572 - RNA, 21 nt, Artificial Sequence
  Synthetic construct
uuacauuuccuccuccauuua

SEQ ID NO: 1573 - RNA, 21 nt, Artificial Sequence
  Synthetic construct
aucuuggaaaucuccuucuuu

SEQ ID NO: 1574 - RNA, 21 nt, Artificial Sequence
  Synthetic construct
uucuaucaaagaauaauaccg

SEQ ID NO: 1575 - RNA, 21 nt, Artificial Sequence
  Synthetic construct
ugcgcugugauaucucaucaa

SEQ ID NO: 1576 - RNA, 21 nt, Artificial Sequence
  Synthetic construct
aagauuguugagaccaaaccg

SEQ ID NO: 1577 - RNA, 21 nt, Artificial Sequence
  Synthetic construct
uugcaagguuuacccgugcuu

SEQ ID NO: 1578 - RNA, 21 nt, Artificial Sequence
  Synthetic construct
uccauuuacagugacauuuag

SEQ ID NO: 1579 - RNA, 21 nt, Artificial Sequence
  Synthetic construct
ugagacacauaggcaauucuu

SEQ ID NO: 1580 - RNA, 21 nt, Artificial Sequence
  Synthetic construct
uaaguaccaguuaagaucuag

SEQ ID NO: 1581 - RNA, 21 nt, Artificial Sequence
  Synthetic construct
auuuagcauacuuuguuuguu

SEQ ID NO: 1582 - RNA, 21 nt, Artificial Sequence
  Synthetic construct
ucuuguuaaagaaggcuucug

SEQ ID NO: 1583 - RNA, 21 nt, Artificial Sequence
  Synthetic construct
aauagagaucuugcuaugcca

SEQ ID NO: 1584 - RNA, 21 nt, Artificial Sequence
  Synthetic construct
ugucagcaucuugauacacug

SEQ ID NO: 1585 - RNA, 21 nt, Artificial Sequence
  Synthetic construct
uacagugacauuuagcauacu

SEQ ID NO: 1586 - RNA, 21 nt, Artificial Sequence
  Synthetic construct
ugagcagagguucgcguccug

SEQ ID NO: 1587 - RNA, 21 nt, Artificial Sequence
  Synthetic construct
ugacaguaaaggaaaggccuu

SEQ ID NO: 1588 - RNA, 21 nt, Artificial Sequence
  Synthetic construct
acaagugucugcuaacuuccg

SEQ ID NO: 1589 - RNA, 21 nt, Artificial Sequence
  Synthetic construct
auacacugcucuugcaagguu

SEQ ID NO: 1590 - RNA, 21 nt, Artificial Sequence
  Synthetic construct
ucacagucagaucaccauccu

SEQ ID NO: 1591 - RNA, 21 nt, Artificial Sequence
  Synthetic construct
uuugagguacugcaacugaug

SEQ ID NO: 1592 - RNA, 21 nt, Artificial Sequence
  Synthetic construct
acacauaggcaauucuuccau

SEQ ID NO: 1593 - RNA, 21 nt, Artificial Sequence
  Synthetic construct
auagaugucagcaucuugaua

SEQ ID NO: 1594 - RNA, 21 nt, Artificial Sequence
  Synthetic construct
uuuacccgugcuuucugcccu

SEQ ID NO: 1595 - RNA, 21 nt, Artificial Sequence
  Synthetic construct
uuccuggaacuggagguuguu

SEQ ID NO: 1596 - RNA, 21 nt, Artificial Sequence
  Synthetic construct
agucagaucaccauccuccaa

SEQ ID NO: 1597 - RNA, 21 nt, Artificial Sequence
  Synthetic construct
uuuaucccagaacccuugcaa

SEQ ID NO: 1598 - RNA, 21 nt, Artificial Sequence
  Synthetic construct
uuccuaucuccauccagagua

SEQ ID NO: 1599 - RNA, 21 nt, Artificial Sequence
  Synthetic construct
uuccucauuauccuucuuuaa

SEQ ID NO: 1600 - RNA, 21 nt, Artificial Sequence
  Synthetic construct
aaucugacuugcagcuuugag

SEQ ID NO: 1601 - RNA, 21 nt, Artificial Sequence
  Synthetic construct
cacaguucgaacaagugucug

SEQ ID NO: 1602 - RNA, 21 nt, Artificial Sequence
  Synthetic construct
uaccaguuaagaucuagcuuc

SEQ ID NO: 1603 - RNA, 21 nt, Artificial Sequence
  Synthetic construct
aguucgaacaagugucugcua

SEQ ID NO: 1604 - RNA, 21 nt, Artificial Sequence
  Synthetic construct
aagugucugcuaacuuccgca

SEQ ID NO: 1605 - RNA, 21 nt, Artificial Sequence
  Synthetic construct
ucugacuugcagcuuugaggu

SEQ ID NO: 1606 - RNA, 21 nt, Artificial Sequence
  Synthetic construct
ucucgguuacauuuccuccuc

SEQ ID NO: 1607 - RNA, 21 nt, Artificial Sequence
  Synthetic construct
uucauucaugguccugauccu

SEQ ID NO: 1608 - RNA, 21 nt, Artificial Sequence
  Synthetic construct
uacgauuccuuagugugggag

SEQ ID NO: 1609 - RNA, 21 nt, Artificial Sequence
  Synthetic construct
uccaacagcuguaaauccuuu

SEQ ID NO: 1610 - RNA, 21 nt, Artificial Sequence
  Synthetic construct
uugugcaaaguuugugaagag

SEQ ID NO: 1611 - RNA, 21 nt, Artificial Sequence
  Synthetic construct
aauaucagaaucugacuugca

SEQ ID NO: 1612 - RNA, 21 nt, Artificial Sequence
  Synthetic construct
ucuuccucuaaucuccguuua

SEQ ID NO: 1613 - RNA, 21 nt, Artificial Sequence
  Synthetic construct
auaagauuuccaguaacacuu

SEQ ID NO: 1614 - RNA, 21 nt, Artificial Sequence
  Synthetic construct
auccugcacaugcaccaucuu

SEQ ID NO: 1615 - RNA, 21 nt, Artificial Sequence
  Synthetic construct
aucuuucaauaucagaaucug

SEQ ID NO: 1616 - RNA, 21 nt, Artificial Sequence
  Synthetic construct
uccugcacaugcaccaucuuu

SEQ ID NO: 1617 - RNA, 21 nt, Artificial Sequence
  Synthetic construct
aacccuugcaacuccucucca

SEQ ID NO: 1618 - RNA, 21 nt, Artificial Sequence
  Synthetic construct
uccuucuuucucaaauuggua

SEQ ID NO: 1619 - RNA, 21 nt, Artificial Sequence
  Synthetic construct
uacuaagacgaagugccucaa

SEQ ID NO: 1620 - RNA, 21 nt, Artificial Sequence
  Synthetic construct
ucaccauccuccaacagcugu

SEQ ID NO: 1621 - RNA, 21 nt, Artificial Sequence
  Synthetic construct
ugucuuuggagaaacgauuua

SEQ ID NO: 1622 - RNA, 21 nt, Artificial Sequence
  Synthetic construct
ugugaucacacugccgaggag

SEQ ID NO: 1623 - RNA, 21 nt, Artificial Sequence
  Synthetic construct
accacagcuaacaauucgcca

SEQ ID NO: 1624 - RNA, 21 nt, Artificial Sequence
  Synthetic construct
uucacaucauuggacagcaga

SEQ ID NO: 1625 - RNA, 21 nt, Artificial Sequence
  Synthetic construct
uucugcccuccacucagcgug

SEQ ID NO: 1626 - RNA, 21 nt, Artificial Sequence
  Synthetic construct
uuuaugauugcucuuguuaaa

SEQ ID NO: 1627 - RNA, 21 nt, Artificial Sequence
  Synthetic construct
accaguuauaacuucauucau

SEQ ID NO: 1628 - RNA, 21 nt, Artificial Sequence
  Synthetic construct
ucuccauccagaguagggcag

SEQ ID NO: 1629 - RNA, 21 nt, Artificial Sequence
  Synthetic construct
caucuugauacacugcucuug

SEQ ID NO: 1630 - RNA, 21 nt, Artificial Sequence
  Synthetic construct
uucaaggagggucuagaagau

SEQ ID NO: 1631 - RNA, 21 nt, Artificial Sequence
  Synthetic construct
uaaagaaggcuucugugcguc

SEQ ID NO: 1632 - RNA, 21 nt, Artificial Sequence
  Synthetic construct
uugauacacugcucuugcaag

SEQ ID NO: 1633 - RNA, 21 nt, Artificial Sequence
  Synthetic construct
uuuccuccuccauuuacagug

SEQ ID NO: 1634 - RNA, 21 nt, Artificial Sequence
  Synthetic construct
aaguguccaaugucuuuggag

SEQ ID NO: 1635 - RNA, 21 nt, Artificial Sequence
  Synthetic construct
ucugagaagguacgauuccuu

SEQ ID NO: 1636 - RNA, 21 nt, Artificial Sequence
  Synthetic construct
acaaauacacaguucgaacaa

SEQ ID NO: 1637 - RNA, 21 nt, Artificial Sequence
  Synthetic construct
ucagaaucuuggaaaucuccu

SEQ ID NO: 1638 - RNA, 21 nt, Artificial Sequence
  Synthetic construct
uuucugcccuccacucagcgu

SEQ ID NO: 1639 - RNA, 21 nt, Artificial Sequence
  Synthetic construct
agugucugcuaacuuccgcau

SEQ ID NO: 1640 - RNA, 21 nt, Artificial Sequence
  Synthetic construct
uaaaggaaaggccuuguagag

SEQ ID NO: 1641 - RNA, 21 nt, Artificial Sequence
  Synthetic construct
uucugugcgucauucucagcu

SEQ ID NO: 1642 - RNA, 21 nt, Artificial Sequence
  Synthetic construct
uccuuagugugggaguuccug

SEQ ID NO: 1643 - RNA, 21 nt, Artificial Sequence
  Synthetic construct
cugacuugcagcuuugaggua

SEQ ID NO: 1644 - RNA, 21 nt, Artificial Sequence
  Synthetic construct
aacagugaugacuucccugcu

SEQ ID NO: 1645 - RNA, 21 nt, Artificial Sequence
  Synthetic construct
ucuagcuucucgguuacauuu

SEQ ID NO: 1646 - RNA, 21 nt, Artificial Sequence
  Synthetic construct
ucuagaagauuguugagacca

SEQ ID NO: 1647 - RNA, 21 nt, Artificial Sequence
  Synthetic construct
uaaccgucagccgcacagccc

SEQ ID NO: 1648 - RNA, 21 nt, Artificial Sequence
  Synthetic construct
uuggacagcagauugacuauc

SEQ ID NO: 1649 - RNA, 21 nt, Artificial Sequence
  Synthetic construct
uaggaacucaguguaaguccc

SEQ ID NO: 1650 - RNA, 21 nt, Artificial Sequence
  Synthetic construct
augcacgcugaccagcccgug

SEQ ID NO: 1651 - RNA, 21 nt, Artificial Sequence
  Synthetic construct
auaucaucuuccucuaaucuc

SEQ ID NO: 1652 - RNA, 21 nt, Artificial Sequence
  Synthetic construct
uuccaguaacacuuuaugauu

SEQ ID NO: 1653 - RNA, 21 nt, Artificial Sequence
  Synthetic construct
acugagaggaucguccaggag

SEQ ID NO: 1654 - RNA, 21 nt, Artificial Sequence
  Synthetic construct
uuacccgugcuuucugcccuc

SEQ ID NO: 1655 - RNA, 21 nt, Artificial Sequence
  Synthetic construct
uaucaucuuccucuaaucucc

SEQ ID NO: 1656 - RNA, 21 nt, Artificial Sequence
  Synthetic construct
cuuaacagugaugacuucccu

SEQ ID NO: 1657 - RNA, 21 nt, Artificial Sequence
  Synthetic construct
aaauucaucccucugaggcag

SEQ ID NO: 1658 - RNA, 21 nt, Artificial Sequence
  Synthetic construct
uccaaguguccaaugucuuug

SEQ ID NO: 1659 - RNA, 21 nt, Artificial Sequence
  Synthetic construct
augauugcucuuguuaaagaa

SEQ ID NO: 1660 - RNA, 21 nt, Artificial Sequence
  Synthetic construct
ugugcgucauucucagcucuu

SEQ ID NO: 1661 - RNA, 21 nt, Artificial Sequence
  Synthetic construct
ugaggcaggaacuucucagaa

SEQ ID NO: 1662 - RNA, 21 nt, Artificial Sequence
  Synthetic construct
uucaccuccugguacacgggc

SEQ ID NO: 1663 - RNA, 21 nt, Artificial Sequence
  Synthetic construct
uccaguaacacuuuaugauug

SEQ ID NO: 1664 - RNA, 21 nt, Artificial Sequence
  Synthetic construct
ucaaacuuguucacaucauug

SEQ ID NO: 1665 - RNA, 21 nt, Artificial Sequence
  Synthetic construct
uaacagugaugacuucccugc

SEQ ID NO: 1666 - RNA, 21 nt, Artificial Sequence
  Synthetic construct
uaucacagucagaucaccauc

SEQ ID NO: 1667 - RNA, 21 nt, Artificial Sequence
  Synthetic construct
uagcauacuuuguuuguuugc

SEQ ID NO: 1668 - RNA, 21 nt, Artificial Sequence
  Synthetic construct
aagacucugagaagguacgau

SEQ ID NO: 1669 - RNA, 21 nt, Artificial Sequence
  Synthetic construct
aacuuguucacaucauuggac

SEQ ID NO: 1670 - RNA, 21 nt, Artificial Sequence
  Synthetic construct
agcaucuugauacacugcucu

SEQ ID NO: 1671 - RNA, 21 nt, Artificial Sequence
  Synthetic construct
uugcgcugugauaucucauca

SEQ ID NO: 1672 - RNA, 21 nt, Artificial Sequence
  Synthetic construct
uggagguuguucacuuuccuc

SEQ ID NO: 1673 - RNA, 21 nt, Artificial Sequence
  Synthetic construct
uaucucaucaaguagcaaaaa

SEQ ID NO: 1674 - RNA, 21 nt, Artificial Sequence
  Synthetic construct
uggugaaggucacaaacacga

SEQ ID NO: 1675 - RNA, 21 nt, Artificial Sequence
  Synthetic construct
aagaggguaaccgucagccgc

SEQ ID NO: 1676 - RNA, 21 nt, Artificial Sequence
  Synthetic construct
uaucagaaucugacuugcagc

SEQ ID NO: 1677 - RNA, 21 nt, Artificial Sequence
  Synthetic construct
acauuuagcauacuuuguuug

SEQ ID NO: 1678 - RNA, 21 nt, Artificial Sequence
  Synthetic construct
uaacaaggacguagaauacca

SEQ ID NO: 1679 - RNA, 21 nt, Artificial Sequence
  Synthetic construct
uugcagcuuugagguacugca

SEQ ID NO: 1680 - RNA, 21 nt, Artificial Sequence
  Synthetic construct
guuaagaucuagcuucucggu

SEQ ID NO: 1681 - RNA, 21 nt, Artificial Sequence
  Synthetic construct
agggucuagaagauuguugag

SEQ ID NO: 1682 - RNA, 21 nt, Artificial Sequence
  Synthetic construct
uaacuucauucaugguccuga

SEQ ID NO: 1683 - RNA, 21 nt, Artificial Sequence
  Synthetic construct
auaaauuccuaaguaccaguu

SEQ ID NO: 1684 - RNA, 21 nt, Artificial Sequence
  Synthetic construct
uuccuuagugugggaguuccu

SEQ ID NO: 1685 - RNA, 21 nt, Artificial Sequence
  Synthetic construct
agaauugacucaaacauuuug

SEQ ID NO: 1686 - RNA, 21 nt, Artificial Sequence
  Synthetic construct
uguuacuaagacgaagugccu

SEQ ID NO: 1687 - RNA, 21 nt, Artificial Sequence
  Synthetic construct
agucacugcaaucgccugcag

SEQ ID NO: 1688 - RNA, 21 nt, Artificial Sequence
  Synthetic construct
aggaaguguaagaacacuguc

SEQ ID NO: 1689 - RNA, 21 nt, Artificial Sequence
  Synthetic construct
cuugauacacugcucuugcaa

SEQ ID NO: 1690 - RNA, 21 nt, Artificial Sequence
  Synthetic construct
ucgguuacauuuccuccucca

SEQ ID NO: 1691 - RNA, 21 nt, Artificial Sequence
  Synthetic construct
uagggcagucacugcaaucgc

SEQ ID NO: 1692 - RNA, 21 nt, Artificial Sequence
  Synthetic construct
ucaaagaauaauaccggagcu

SEQ ID NO: 1693 - RNA, 21 nt, Artificial Sequence
  Synthetic construct
uucuuccuauuggauuucuau

SEQ ID NO: 1694 - RNA, 21 nt, Artificial Sequence
  Synthetic construct
ucagaauugacucaaacauuu

SEQ ID NO: 1695 - RNA, 21 nt, Artificial Sequence
  Synthetic construct
uuguucacaucauuggacagc

SEQ ID NO: 1696 - RNA, 21 nt, Artificial Sequence
  Synthetic construct
uauuauccuuauaccaguuau

SEQ ID NO: 1697 - RNA, 21 nt, Artificial Sequence
  Synthetic construct
uugaagcacauaggcaacauc

SEQ ID NO: 1698 - RNA, 21 nt, Artificial Sequence
  Synthetic construct
ugcuaacuuccgcaucuacug

SEQ ID NO: 1699 - RNA, 21 nt, Artificial Sequence
  Synthetic construct
gugaugagaacaacuucccaa

SEQ ID NO: 1700 - RNA, 21 nt, Artificial Sequence
  Synthetic construct
ucuccaaggugcugugagcgg

SEQ ID NO: 1701 - RNA, 21 nt, Artificial Sequence
  Synthetic construct
uaucuccauccagaguagggc

SEQ ID NO: 1702 - RNA, 21 nt, Artificial Sequence
  Synthetic construct
uaccaucuuucaauaucagaa

SEQ ID NO: 1703 - RNA, 21 nt, Artificial Sequence
  Synthetic construct
ucguccaggagauagauguca

SEQ ID NO: 1704 - RNA, 21 nt, Artificial Sequence
  Synthetic construct
auccaaguguccaaugucuuu

SEQ ID NO: 1705 - RNA, 21 nt, Artificial Sequence
  Synthetic construct
agcuuugagguacugcaacug

SEQ ID NO: 1706 - RNA, 21 nt, Artificial Sequence
  Synthetic construct
auugccucugacacccucuca

SEQ ID NO: 1707 - RNA, 21 nt, Artificial Sequence
  Synthetic construct
cagaaucuuggaaaucuccuu

SEQ ID NO: 1708 - RNA, 21 nt, Artificial Sequence
  Synthetic construct
ucuccuucuuucucaaauugg

SEQ ID NO: 1709 - RNA, 21 nt, Artificial Sequence
  Synthetic construct
acuucuuuaucccagaacccu

SEQ ID NO: 1710 - RNA, 21 nt, Artificial Sequence
  Synthetic construct
acuuuccucauuauccuucuu

SEQ ID NO: 1711 - RNA, 21 nt, Artificial Sequence
  Synthetic construct
uacauaucaucuuccucuaau

SEQ ID NO: 1712 - RNA, 21 nt, Artificial Sequence
  Synthetic construct
cuaacuuccgcaucuacugca

SEQ ID NO: 1713 - RNA, 21 nt, Artificial Sequence
  Synthetic construct
ucggaugcugacgauugccuc

SEQ ID NO: 1714 - RNA, 21 nt, Artificial Sequence
  Synthetic construct
aauacacaguucgaacaagug

SEQ ID NO: 1715 - RNA, 21 nt, Artificial Sequence
  Synthetic construct
aaguuugugaagaguuaacaa

SEQ ID NO: 1716 - RNA, 21 nt, Artificial Sequence
  Synthetic construct
ucaaauugguaauaagauuug

SEQ ID NO: 1717 - RNA, 21 nt, Artificial Sequence
  Synthetic construct
acuugcagcuuugagguacug

SEQ ID NO: 1718 - RNA, 21 nt, Artificial Sequence
  Synthetic construct
uugcaagggcaggagaaugau

SEQ ID NO: 1719 - RNA, 21 nt, Artificial Sequence
  Synthetic construct
gauauuccuaucuccauccag

SEQ ID NO: 1720 - RNA, 21 nt, Artificial Sequence
  Synthetic construct
uccuauuggauuucuaucaaa

SEQ ID NO: 1721 - RNA, 21 nt, Artificial Sequence
  Synthetic construct
ugguacacgggcagcaucuug

SEQ ID NO: 1722 - RNA, 21 nt, Artificial Sequence
  Synthetic construct
acugucaccugaucaaacuug

SEQ ID NO: 1723 - RNA, 21 nt, Artificial Sequence
  Synthetic construct
uggaaaucuccuucuuucuca

SEQ ID NO: 1724 - RNA, 21 nt, Artificial Sequence
  Synthetic construct
aguuaagaucuagcuucucgg

SEQ ID NO: 1725 - RNA, 21 nt, Artificial Sequence
  Synthetic construct
auuuccaguaacacuuuauga

SEQ ID NO: 1726 - RNA, 21 nt, Artificial Sequence
  Synthetic construct
aucagaaucugacuugcagcu

SEQ ID NO: 1727 - RNA, 21 nt, Artificial Sequence
  Synthetic construct
aagaaggcuucugugcgucau

SEQ ID NO: 1728 - RNA, 21 nt, Artificial Sequence
  Synthetic construct
acccuugcaacuccucuccaa

SEQ ID NO: 1729 - RNA, 21 nt, Artificial Sequence
  Synthetic construct
ugaccagcccgugacuugggg

SEQ ID NO: 1730 - RNA, 21 nt, Artificial Sequence
  Synthetic construct
cuaaguaccaguuaagaucua

SEQ ID NO: 1731 - RNA, 21 nt, Artificial Sequence
  Synthetic construct
uucccgagaacacccagggcu

SEQ ID NO: 1732 - RNA, 21 nt, Artificial Sequence
  Synthetic construct
uacuuuguuuguuugcccagu

SEQ ID NO: 1733 - RNA, 21 nt, Artificial Sequence
  Synthetic construct
aauucuuccaugcacgcugac

SEQ ID NO: 1734 - RNA, 21 nt, Artificial Sequence
  Synthetic construct
ucagugaugagaacaacuucc

SEQ ID NO: 1735 - RNA, 21 nt, Artificial Sequence
  Synthetic construct
augacuucccugcucccacgg

SEQ ID NO: 1736 - RNA, 21 nt, Artificial Sequence
  Synthetic construct
auucuuccuauuggauuucua

SEQ ID NO: 1737 - RNA, 21 nt, Artificial Sequence
  Synthetic construct
uuuccucauuauccuucuuua

SEQ ID NO: 1738 - RNA, 21 nt, Artificial Sequence
  Synthetic construct
uaccggagcuuucagaauuga

SEQ ID NO: 1739 - RNA, 21 nt, Artificial Sequence
  Synthetic construct
auaggcaauucuuccaugcac

SEQ ID NO: 1740 - RNA, 21 nt, Artificial Sequence
  Synthetic construct
uuucaauaucagaaucugacu

SEQ ID NO: 1741 - RNA, 21 nt, Artificial Sequence
  Synthetic construct
aguuauaacuucauucauggu

SEQ ID NO: 1742 - RNA, 21 nt, Artificial Sequence
  Synthetic construct
uucggaugcugacgauugccu

SEQ ID NO: 1743 - RNA, 21 nt, Artificial Sequence
  Synthetic construct
caagugucugcuaacuuccgc

SEQ ID NO: 1744 - RNA, 21 nt, Artificial Sequence
  Synthetic construct
ucugcuaacuuccgcaucuac

SEQ ID NO: 1745 - RNA, 21 nt, Artificial Sequence
  Synthetic construct
ugggaguuccuggaacuggag

SEQ ID NO: 1746 - RNA, 21 nt, Artificial Sequence
  Synthetic construct
cuaucaaagaauaauaccgga

SEQ ID NO: 1747 - RNA, 21 nt, Artificial Sequence
  Synthetic construct
acuuccgcaucuacugcacug

SEQ ID NO: 1748 - RNA, 21 nt, Artificial Sequence
  Synthetic construct
uucucaaauugguaauaagau

SEQ ID NO: 1749 - RNA, 21 nt, Artificial Sequence
  Synthetic construct
auuguugagaccaaaccgaag

SEQ ID NO: 1750 - RNA, 21 nt, Artificial Sequence
  Synthetic construct
caaucuugaagcacauaggca

SEQ ID NO: 1751 - RNA, 21 nt, Artificial Sequence
  Synthetic construct
uguccgcucggcuggagccug

SEQ ID NO: 1752 - RNA, 21 nt, Artificial Sequence
  Synthetic construct
aggagggucuagaagauuguu

SEQ ID NO: 1753 - RNA, 21 nt, Artificial Sequence
  Synthetic construct
ugcucuuguuaaagaaggcuu

SEQ ID NO: 1754 - RNA, 21 nt, Artificial Sequence
  Synthetic construct
uuuguuuguuugcccaguaug

SEQ ID NO: 1755 - RNA, 21 nt, Artificial Sequence
  Synthetic construct
uuccuaaguaccaguuaagau

SEQ ID NO: 1756 - RNA, 21 nt, Artificial Sequence
  Synthetic construct
ucuccuaucacagucagauca

SEQ ID NO: 1757 - RNA, 21 nt, Artificial Sequence
  Synthetic construct
ucacaucauuggacagcagau

SEQ ID NO: 1758 - RNA, 21 nt, Artificial Sequence
  Synthetic construct
uaccaguuauaacuucauuca

SEQ ID NO: 1759 - RNA, 21 nt, Artificial Sequence
  Synthetic construct
uuacagugacauuuagcauac

SEQ ID NO: 1760 - RNA, 21 nt, Artificial Sequence
  Synthetic construct
ugacuucccugcucccacggg

SEQ ID NO: 1761 - RNA, 21 nt, Artificial Sequence
  Synthetic construct
uagcuucucgguuacauuucc

SEQ ID NO: 1762 - RNA, 21 nt, Artificial Sequence
  Synthetic construct
aaauugguaauaagauuugaa

SEQ ID NO: 1763 - RNA, 21 nt, Artificial Sequence
  Synthetic construct
acagugacauuuagcauacuu

SEQ ID NO: 1764 - RNA, 21 nt, Artificial Sequence
  Synthetic construct
caaguguccaaugucuuugga

SEQ ID NO: 1765 - RNA, 21 nt, Artificial Sequence
  Synthetic construct
agaguuaacaaggacguagaa

SEQ ID NO: 1766 - RNA, 21 nt, Artificial Sequence
  Synthetic construct
guaccaguuaagaucuagcuu

SEQ ID NO: 1767 - RNA, 21 nt, Artificial Sequence
  Synthetic construct
auuggacagcagauugacuau

SEQ ID NO: 1768 - RNA, 21 nt, Artificial Sequence
  Synthetic construct
agaaucugacuugcagcuuug

SEQ ID NO: 1769 - RNA, 21 nt, Artificial Sequence
  Synthetic construct
uggauuucuaucaaagaauaa

SEQ ID NO: 1770 - RNA, 21 nt, Artificial Sequence
  Synthetic construct
agaauaccaauagagaucuug

SEQ ID NO: 1771 - RNA, 21 nt, Artificial Sequence
  Synthetic construct
ugaauaaauuccuaaguacca

SEQ ID NO: 1772 - RNA, 21 nt, Artificial Sequence
  Synthetic construct
aucaaacuuguucacaucauu

SEQ ID NO: 1773 - RNA, 21 nt, Artificial Sequence
  Synthetic construct
aucauuggacagcagauugac

SEQ ID NO: 1774 - RNA, 21 nt, Artificial Sequence
  Synthetic construct
ucagcggcagcaaaucaucca

SEQ ID NO: 1775 - RNA, 21 nt, Artificial Sequence
  Synthetic construct
agugacauuuagcauacuuug

SEQ ID NO: 1776 - RNA, 21 nt, Artificial Sequence
  Synthetic construct
cacuuuaugauugcucuuguu

SEQ ID NO: 1777 - RNA, 21 nt, Artificial Sequence
  Synthetic construct
uagaugucagcaucuugauac

SEQ ID NO: 1778 - RNA, 21 nt, Artificial Sequence
  Synthetic construct
caucuuccucuaaucuccguu

SEQ ID NO: 1779 - RNA, 21 nt, Artificial Sequence
  Synthetic construct
cugaauacauaucaucuuccu

SEQ ID NO: 1780 - RNA, 21 nt, Artificial Sequence
  Synthetic construct
acagugaugacuucccugcuc

SEQ ID NO: 1781 - RNA, 21 nt, Artificial Sequence
  Synthetic construct
uuauccuuauaccaguuauaa

SEQ ID NO: 1782 - RNA, 21 nt, Artificial Sequence
  Synthetic construct
uccuuauaccaguuauaacuu

SEQ ID NO: 1783 - RNA, 21 nt, Artificial Sequence
  Synthetic construct
uguugugcaaaguuugugaag

SEQ ID NO: 1784 - RNA, 21 nt, Artificial Sequence
  Synthetic construct
ugacuugcagcuuugagguac

SEQ ID NO: 1785 - RNA, 21 nt, Artificial Sequence
  Synthetic construct
acugcaacugaugagucacua

SEQ ID NO: 1786 - RNA, 21 nt, Artificial Sequence
  Synthetic construct
acacgggcagcaucuugccgg

SEQ ID NO: 1787 - RNA, 21 nt, Artificial Sequence
  Synthetic construct
uguuuguuugcccaguaugaa

SEQ ID NO: 1788 - RNA, 21 nt, Artificial Sequence
  Synthetic construct
auuugacaaauacacaguucg

SEQ ID NO: 1789 - RNA, 21 nt, Artificial Sequence
  Synthetic construct
uucgcguccugcagcggguug

SEQ ID NO: 1790 - RNA, 21 nt, Artificial Sequence
  Synthetic construct
uuaugauugcucuuguuaaag

SEQ ID NO: 1791 - RNA, 21 nt, Artificial Sequence
  Synthetic construct
ucugugcgucauucucagcuc

SEQ ID NO: 1792 - RNA, 21 nt, Artificial Sequence
  Synthetic construct
aaggucacaaacacgaugauu

SEQ ID NO: 1793 - RNA, 21 nt, Artificial Sequence
  Synthetic construct
uuccuccuccauuuacaguga

SEQ ID NO: 1794 - RNA, 21 nt, Artificial Sequence
  Synthetic construct
ucucagaaucuuggaaaucuc

SEQ ID NO: 1795 - RNA, 21 nt, Artificial Sequence
  Synthetic construct
ugauacacugcucuugcaagg

SEQ ID NO: 1796 - RNA, 21 nt, Artificial Sequence
  Synthetic construct
uuguugagaccaaaccgaaga

SEQ ID NO: 1797 - RNA, 21 nt, Artificial Sequence
  Synthetic construct
auugugaucuucucaugcaaa

SEQ ID NO: 1798 - RNA, 21 nt, Artificial Sequence
  Synthetic construct
agaguucccgagaacacccag

SEQ ID NO: 1799 - RNA, 21 nt, Artificial Sequence
  Synthetic construct
acaggaaguguaagaacacug

SEQ ID NO: 1800 - RNA, 21 nt, Artificial Sequence
  Synthetic construct
aagaacacugucaccugauca

SEQ ID NO: 1801 - RNA, 21 nt, Artificial Sequence
  Synthetic construct
uuacuaagacgaagugccuca

SEQ ID NO: 1802 - RNA, 21 nt, Artificial Sequence
  Synthetic construct
aucuccuucuuucucaaauug

SEQ ID NO: 1803 - RNA, 21 nt, Artificial Sequence
  Synthetic construct
acacaguucgaacaagugucu

SEQ ID NO: 1804 - RNA, 21 nt, Artificial Sequence
  Synthetic construct
aucuuccucuaaucuccguuu

SEQ ID NO: 1805 - RNA, 21 nt, Artificial Sequence
  Synthetic construct
ucaccugaucaaacuuguuca

SEQ ID NO: 1806 - RNA, 21 nt, Artificial Sequence
  Synthetic construct
uacugcaacugaugagucacu

SEQ ID NO: 1807 - RNA, 21 nt, Artificial Sequence
  Synthetic construct
ucaaggagggucuagaagauu

SEQ ID NO: 1808 - RNA, 21 nt, Artificial Sequence
  Synthetic construct
ugagaggaucguccaggagau

SEQ ID NO: 1809 - RNA, 21 nt, Artificial Sequence
  Synthetic construct
aguguaagaacacugucaccu

SEQ ID NO: 1810 - RNA, 21 nt, Artificial Sequence
  Synthetic construct
uccuccuccauuuacagugac

SEQ ID NO: 1811 - RNA, 21 nt, Artificial Sequence
  Synthetic construct
uagcuacaguuaaaccugaau

SEQ ID NO: 1812 - RNA, 21 nt, Artificial Sequence
  Synthetic construct
ugagaagguacgauuccuuag

SEQ ID NO: 1813 - RNA, 21 nt, Artificial Sequence
  Synthetic construct
uucuuucucaaauugguaaua

SEQ ID NO: 1814 - RNA, 21 nt, Artificial Sequence
  Synthetic construct
uccagaguagggcagucacug

SEQ ID NO: 1815 - RNA, 21 nt, Artificial Sequence
  Synthetic construct
aaaggccuuguagaguugggg

SEQ ID NO: 1816 - RNA, 21 nt, Artificial Sequence
  Synthetic construct
uuaacaaggacguagaauacc

SEQ ID NO: 1817 - RNA, 21 nt, Artificial Sequence
  Synthetic construct
uuggauuucuaucaaagaaua

SEQ ID NO: 1818 - RNA, 21 nt, Artificial Sequence
  Synthetic construct
ugcuuucugcccuccacucag

SEQ ID NO: 1819 - RNA, 21 nt, Artificial Sequence
  Synthetic construct
uuguuuguuugcccaguauga

SEQ ID NO: 1820 - RNA, 21 nt, Artificial Sequence
  Synthetic construct
uucaucccucugaggcaggaa

SEQ ID NO: 1821 - RNA, 21 nt, Artificial Sequence
  Synthetic construct
agaaucuuggaaaucuccuuc

SEQ ID NO: 1822 - RNA, 21 nt, Artificial Sequence
  Synthetic construct
uaccaucugacggcagcugac

SEQ ID NO: 1823 - RNA, 21 nt, Artificial Sequence
  Synthetic construct
auuacuccucagaguucccga

SEQ ID NO: 1824 - RNA, 21 nt, Artificial Sequence
  Synthetic construct
gagaaugauuagaacugccau

SEQ ID NO: 1825 - RNA, 21 nt, Artificial Sequence
  Synthetic construct
acguagaauaccaauagagau

SEQ ID NO: 1826 - RNA, 21 nt, Artificial Sequence
  Synthetic construct
uugugaucuucucaugcaaaa

SEQ ID NO: 1827 - RNA, 21 nt, Artificial Sequence
  Synthetic construct
uacauuuccuccuccauuuac

SEQ ID NO: 1828 - RNA, 21 nt, Artificial Sequence
  Synthetic construct
ugaucaaacuuguucacauca

SEQ ID NO: 1829 - RNA, 21 nt, Artificial Sequence
  Synthetic construct
gaacuucucagaaucuuggaa

SEQ ID NO: 1830 - RNA, 21 nt, Artificial Sequence
  Synthetic construct
uuccucuaaucuccguuuaug

SEQ ID NO: 1831 - RNA, 21 nt, Artificial Sequence
  Synthetic construct
uaggcaauucuuccaugcacg

SEQ ID NO: 1832 - RNA, 21 nt, Artificial Sequence
  Synthetic construct
ugugggaguuccuggaacugg

SEQ ID NO: 1833 - RNA, 21 nt, Artificial Sequence
  Synthetic construct
aucuccauccagaguagggca

SEQ ID NO: 1834 - RNA, 21 nt, Artificial Sequence
  Synthetic construct
auuccuaucuccauccagagu

SEQ ID NO: 1835 - RNA, 21 nt, Artificial Sequence
  Synthetic construct
ugaaggucacaaacacgauga

SEQ ID NO: 1836 - RNA, 21 nt, Artificial Sequence
  Synthetic construct
ucacuuuccucauuauccuuc

SEQ ID NO: 1837 - RNA, 21 nt, Artificial Sequence
  Synthetic construct
aaguguaagaacacugucacc

SEQ ID NO: 1838 - RNA, 21 nt, Artificial Sequence
  Synthetic construct
agaacacugucaccugaucaa

SEQ ID NO: 1839 - RNA, 21 nt, Artificial Sequence
  Synthetic construct
aacuucauucaugguccugau

SEQ ID NO: 1840 - RNA, 21 nt, Artificial Sequence
  Synthetic construct
aagguuuacccgugcuuucug

SEQ ID NO: 1841 - RNA, 21 nt, Artificial Sequence
  Synthetic construct
ucacugcaaucgccugcagug

SEQ ID NO: 1842 - RNA, 21 nt, Artificial Sequence
  Synthetic construct
ucgccugcagugguccugccc

SEQ ID NO: 1843 - RNA, 21 nt, Artificial Sequence
  Synthetic construct
uccgcaucuacugcacugaga

SEQ ID NO: 1844 - RNA, 21 nt, Artificial Sequence
  Synthetic construct
ugagaccaaaccgaagacucu

SEQ ID NO: 1845 - RNA, 21 nt, Artificial Sequence
  Synthetic construct
ucuuucaaggagggucuagaa

SEQ ID NO: 1846 - RNA, 21 nt, Artificial Sequence
  Synthetic construct
agcuucucgguuacauuuccu

SEQ ID NO: 1847 - RNA, 21 nt, Artificial Sequence
  Synthetic construct
aacaagugucugcuaacuucc

SEQ ID NO: 1848 - RNA, 21 nt, Artificial Sequence
  Synthetic construct
guguaagaacacugucaccug

SEQ ID NO: 1849 - RNA, 21 nt, Artificial Sequence
  Synthetic construct
cuuugagguacugcaacugau

SEQ ID NO: 1850 - RNA, 21 nt, Artificial Sequence
  Synthetic construct
ugaagcacauaggcaacaucu

SEQ ID NO: 1851 - RNA, 21 nt, Artificial Sequence
  Synthetic construct
uucuuccaugcacgcugacca

SEQ ID NO: 1852 - RNA, 21 nt, Artificial Sequence
  Synthetic construct
aauaauaccggagcuuucaga

SEQ ID NO: 1853 - RNA, 21 nt, Artificial Sequence
  Synthetic construct
cagaucaccauccuccaacag

SEQ ID NO: 1854 - RNA, 21 nt, Artificial Sequence
  Synthetic construct
uugagaccaaaccgaagacuc

SEQ ID NO: 1855 - RNA, 21 nt, Artificial Sequence
  Synthetic construct
aagaucuagcuucucgguuac

SEQ ID NO: 1856 - RNA, 21 nt, Artificial Sequence
  Synthetic construct
aggaacuucucagaaucuugg

SEQ ID NO: 1857 - RNA, 21 nt, Artificial Sequence
  Synthetic construct
ucauccaaguguccaaugucu

SEQ ID NO: 1858 - RNA, 21 nt, Artificial Sequence
  Synthetic construct
augucuuuggagaaacgauuu

SEQ ID NO: 1859 - RNA, 21 nt, Artificial Sequence
  Synthetic construct
aggaacucaguguaagucccc

SEQ ID NO: 1860 - RNA, 21 nt, Artificial Sequence
  Synthetic construct
caaagaauaauaccggagcuu

SEQ ID NO: 1861 - RNA, 21 nt, Artificial Sequence
  Synthetic construct
uggaacuggagguuguucacu

SEQ ID NO: 1862 - RNA, 21 nt, Artificial Sequence
  Synthetic construct
agcacauaggcaacaucuugg

SEQ ID NO: 1863 - RNA, 21 nt, Artificial Sequence
  Synthetic construct
acgauugccucugacacccuc

SEQ ID NO: 1864 - RNA, 21 nt, Artificial Sequence
  Synthetic construct
ugaugagaacaacuucccaaa

SEQ ID NO: 1865 - RNA, 21 nt, Artificial Sequence
  Synthetic construct
uugguaauaagauuugaaaau

SEQ ID NO: 1866 - RNA, 21 nt, Artificial Sequence
  Synthetic construct
uaauaccggagcuuucagaau

SEQ ID NO: 1867 - RNA, 21 nt, Artificial Sequence
  Synthetic construct
caaucgccugcagugguccug

SEQ ID NO: 1868 - RNA, 21 nt, Artificial Sequence
  Synthetic construct
ugcaaaguuugugaagaguua

SEQ ID NO: 1869 - RNA, 21 nt, Artificial Sequence
  Synthetic construct
aagaacacgcgugagcagagg

SEQ ID NO: 1870 - RNA, 21 nt, Artificial Sequence
  Synthetic construct
uccuaucuccauccagaguag

SEQ ID NO: 1871 - RNA, 21 nt, Artificial Sequence
  Synthetic construct
aacuuccgcaucuacugcacu

SEQ ID NO: 1872 - RNA, 21 nt, Artificial Sequence
  Synthetic construct
agaagguacgauuccuuagug

SEQ ID NO: 1873 - RNA, 21 nt, Artificial Sequence
  Synthetic construct
ugcaacugaugagucacuaaa

SEQ ID NO: 1874 - RNA, 21 nt, Artificial Sequence
  Synthetic construct
ugucugcuaacuuccgcaucu

SEQ ID NO: 1875 - RNA, 21 nt, Artificial Sequence
  Synthetic construct
ucacacugccgaggagcacgu

SEQ ID NO: 1876 - RNA, 21 nt, Artificial Sequence
  Synthetic construct
augcugacgauugccucugac

SEQ ID NO: 1877 - RNA, 21 nt, Artificial Sequence
  Synthetic construct
gucugcuaacuuccgcaucua

SEQ ID NO: 1878 - RNA, 21 nt, Artificial Sequence
  Synthetic construct
cauacuuuguuuguuugccca

SEQ ID NO: 1879 - RNA, 21 nt, Artificial Sequence
  Synthetic construct
aguaacacuuuaugauugcuc

SEQ ID NO: 1880 - RNA, 21 nt, Artificial Sequence
  Synthetic construct
gaauaaauuccuaaguaccag

SEQ ID NO: 1881 - RNA, 21 nt, Artificial Sequence
  Synthetic construct
ucuggauucuucggaugcuga

SEQ ID NO: 1882 - RNA, 21 nt, Artificial Sequence
  Synthetic construct
gacagcagauugacuaucugg

SEQ ID NO: 1883 - RNA, 21 nt, Artificial Sequence
  Synthetic construct
cuccagagcaccaucuuucaa

SEQ ID NO: 1884 - RNA, 21 nt, Artificial Sequence
  Synthetic construct
cagaagaacacgcgugagcag

SEQ ID NO: 1885 - RNA, 21 nt, Artificial Sequence
  Synthetic construct
guucacaucauuggacagcag

SEQ ID NO: 1886 - RNA, 21 nt, Artificial Sequence
  Synthetic construct
ucucaaauugguaauaagauu

SEQ ID NO: 1887 - RNA, 21 nt, Artificial Sequence
  Synthetic construct
ucugacggcagcugacgguug

SEQ ID NO: 1888 - RNA, 21 nt, Artificial Sequence
  Synthetic construct
uuguucacuuuccucauuauc

SEQ ID NO: 1889 - RNA, 21 nt, Artificial Sequence
  Synthetic construct
agcacggcacuuaacagugau

SEQ ID NO: 1890 - RNA, 21 nt, Artificial Sequence
  Synthetic construct
guagcuacaguuaaaccugaa

SEQ ID NO: 1891 - RNA, 21 nt, Artificial Sequence
  Synthetic construct
uuugcccaguaugaaagccac

SEQ ID NO: 1892 - RNA, 21 nt, Artificial Sequence
  Synthetic construct
ugguccugcccacaggaagug

SEQ ID NO: 1893 - RNA, 21 nt, Artificial Sequence
  Synthetic construct
aguuugugaagaguuaacaag

SEQ ID NO: 1894 - RNA, 21 nt, Artificial Sequence
  Synthetic construct
gauuguugagaccaaaccgaa

SEQ ID NO: 1895 - RNA, 21 nt, Artificial Sequence
  Synthetic construct
ccacagcuaacaauucgccag

SEQ ID NO: 1896 - RNA, 21 nt, Artificial Sequence
  Synthetic construct
aucccucugaggcaggaacuu

SEQ ID NO: 1897 - RNA, 21 nt, Artificial Sequence
  Synthetic construct
cacagucagaucaccauccuc

SEQ ID NO: 1898 - RNA, 21 nt, Artificial Sequence
  Synthetic construct
aacuccucuccaaggugcugu

SEQ ID NO: 1899 - RNA, 21 nt, Artificial Sequence
  Synthetic construct
ucgaacaagugucugcuaacu

SEQ ID NO: 1900 - RNA, 21 nt, Artificial Sequence
  Synthetic construct
ucugacaguaaaggaaaggcc

SEQ ID NO: 1901 - RNA, 21 nt, Artificial Sequence
  Synthetic construct
uugggcuucaccuccugguac

SEQ ID NO: 1902 - RNA, 21 nt, Artificial Sequence
  Synthetic construct
auucuucggaugcugacgauu

SEQ ID NO: 1903 - RNA, 21 nt, Artificial Sequence
  Synthetic construct
gcacugaauacauaucaucuu

SEQ ID NO: 1904 - RNA, 21 nt, Artificial Sequence
  Synthetic construct
uaagacgaagugccucaauua

SEQ ID NO: 1905 - RNA, 21 nt, Artificial Sequence
  Synthetic construct
aaugucuuuggagaaacgauu

SEQ ID NO: 1906 - RNA, 21 nt, Artificial Sequence
  Synthetic construct
cuuguucacaucauuggacag

SEQ ID NO: 1907 - RNA, 21 nt, Artificial Sequence
  Synthetic construct
aucauccaaguguccaauguc

SEQ ID NO: 1908 - RNA, 21 nt, Artificial Sequence
  Synthetic construct
uaagaacacugucaccugauc

SEQ ID NO: 1909 - RNA, 21 nt, Artificial Sequence
  Synthetic construct
aucugacggcagcugacgguu

SEQ ID NO: 1910 - RNA, 21 nt, Artificial Sequence
  Synthetic construct
aggaucguccaggagauagau

SEQ ID NO: 1911 - RNA, 21 nt, Artificial Sequence
  Synthetic construct
cagaaucugacuugcagcuuu

SEQ ID NO: 1912 - RNA, 21 nt, Artificial Sequence
  Synthetic construct
agcacaagccuuuaugacuuu

SEQ ID NO: 1913 - RNA, 21 nt, Artificial Sequence
  Synthetic construct
gagcuuucagaauugacucaa

SEQ ID NO: 1914 - RNA, 21 nt, Artificial Sequence
  Synthetic construct
auccgugaaaguugcaguuuu

SEQ ID NO: 1915 - RNA, 21 nt, Artificial Sequence
  Synthetic construct
uccaggagauagaugucagca

SEQ ID NO: 1916 - RNA, 21 nt, Artificial Sequence
  Synthetic construct
acacuuuaugauugcucuugu

SEQ ID NO: 1917 - RNA, 21 nt, Artificial Sequence
  Synthetic construct
ugcaagguuuacccgugcuuu

SEQ ID NO: 1918 - RNA, 21 nt, Artificial Sequence
  Synthetic construct
uggaccucaagcagggaugcu

SEQ ID NO: 1919 - RNA, 21 nt, Artificial Sequence
  Synthetic construct
aaauuccuaaguaccaguuaa

SEQ ID NO: 1920 - RNA, 21 nt, Artificial Sequence
  Synthetic construct
gagaccaaaccgaagacucug

SEQ ID NO: 1921 - RNA, 21 nt, Artificial Sequence
  Synthetic construct
acuuuaugauugcucuuguua

SEQ ID NO: 1922 - RNA, 21 nt, Artificial Sequence
  Synthetic construct
uccucuccaaggugcugugag

SEQ ID NO: 1923 - RNA, 21 nt, Artificial Sequence
  Synthetic construct
agguucgcguccugcagcggg

SEQ ID NO: 1924 - RNA, 21 nt, Artificial Sequence
  Synthetic construct
uacaguuaaaccugaauaaau

SEQ ID NO: 1925 - RNA, 21 nt, Artificial Sequence
  Synthetic construct
cagagcaccaucuuucaagga

SEQ ID NO: 1926 - RNA, 21 nt, Artificial Sequence
  Synthetic construct
acgguagcuacaguuaaaccu

SEQ ID NO: 1927 - RNA, 21 nt, Artificial Sequence
  Synthetic construct
aagguacgauuccuuagugug

SEQ ID NO: 1928 - RNA, 21 nt, Artificial Sequence
  Synthetic construct
aacuucucagaaucuuggaaa

SEQ ID NO: 1929 - RNA, 21 nt, Artificial Sequence
  Synthetic construct
cucagugaugagaacaacuuc

SEQ ID NO: 1930 - RNA, 21 nt, Artificial Sequence
  Synthetic construct
cacacugccgaggagcacgua

SEQ ID NO: 1931 - RNA, 21 nt, Artificial Sequence
  Synthetic construct
aucugacuugcagcuuugagg

SEQ ID NO: 1932 - RNA, 21 nt, Artificial Sequence
  Synthetic construct
gauucuucggaugcugacgau

SEQ ID NO: 1933 - RNA, 21 nt, Artificial Sequence
  Synthetic construct
acugcaaucgccugcaguggu

SEQ ID NO: 1934 - RNA, 21 nt, Artificial Sequence
  Synthetic construct
uccuccauuuacagugacauu

SEQ ID NO: 1935 - RNA, 21 nt, Artificial Sequence
  Synthetic construct
caacuccucuccaaggugcug

SEQ ID NO: 1936 - RNA, 21 nt, Artificial Sequence
  Synthetic construct
uucuucggaugcugacgauug

SEQ ID NO: 1937 - RNA, 21 nt, Artificial Sequence
  Synthetic construct
aaaccgaagacucugagaagg

SEQ ID NO: 1938 - RNA, 21 nt, Artificial Sequence
  Synthetic construct
cagcaucuugauacacugcuc

SEQ ID NO: 1939 - RNA, 21 nt, Artificial Sequence
  Synthetic construct
ucuccagagcaccaucuuuca

SEQ ID NO: 1940 - RNA, 21 nt, Artificial Sequence
  Synthetic construct
caaacuuguucacaucauugg

SEQ ID NO: 1941 - RNA, 21 nt, Artificial Sequence
  Synthetic construct
agaguagggcagucacugcaa

SEQ ID NO: 1942 - RNA, 21 nt, Artificial Sequence
  Synthetic construct
ucuuggaaaucuccuucuuuc

SEQ ID NO: 1943 - RNA, 21 nt, Artificial Sequence
  Synthetic construct
uuucuaucaaagaauaauacc

SEQ ID NO: 1944 - RNA, 21 nt, Artificial Sequence
  Synthetic construct
ucaccuccugguacacgggca

SEQ ID NO: 1945 - RNA, 21 nt, Artificial Sequence
  Synthetic construct
aucuacugcacugagaggauc

SEQ ID NO: 1946 - RNA, 21 nt, Artificial Sequence
  Synthetic construct
uccgcucggcuggagccugug

SEQ ID NO: 1947 - RNA, 21 nt, Artificial Sequence
  Synthetic construct
aucuugauacacugcucuugc

SEQ ID NO: 1948 - RNA, 21 nt, Artificial Sequence
  Synthetic construct
guucgaacaagugucugcuaa

SEQ ID NO: 1949 - RNA, 21 nt, Artificial Sequence
  Synthetic construct
auuuccuccuccauuuacagu

SEQ ID NO: 1950 - RNA, 21 nt, Artificial Sequence
  Synthetic construct
ucuugaagcacauaggcaaca

SEQ ID NO: 1951 - RNA, 21 nt, Artificial Sequence
  Synthetic construct
uccgugaaaguugcaguuuua

SEQ ID NO: 1952 - RNA, 21 nt, Artificial Sequence
  Synthetic construct
ugacggcagcugacgguugcg

SEQ ID NO: 1953 - RNA, 21 nt, Artificial Sequence
  Synthetic construct
uccuggaccucaagcagggau

SEQ ID NO: 1954 - RNA, 21 nt, Artificial Sequence
  Synthetic construct
caucugacggcagcugacggu

SEQ ID NO: 1955 - RNA, 21 nt, Artificial Sequence
  Synthetic construct
aaggagggucuagaagauugu

SEQ ID NO: 1956 - RNA, 21 nt, Artificial Sequence
  Synthetic construct
cuucuuuaucccagaacccuu

SEQ ID NO: 1957 - RNA, 21 nt, Artificial Sequence
  Synthetic construct
uccagagcaccaucuuucaag

SEQ ID NO: 1958 - RNA, 21 nt, Artificial Sequence
  Synthetic construct
accgaagacucugagaaggua

SEQ ID NO: 1959 - RNA, 21 nt, Artificial Sequence
  Synthetic construct
aaucauccaaguguccaaugu

SEQ ID NO: 1960 - RNA, 21 nt, Artificial Sequence
  Synthetic construct
aauaagauuuccaguaacacu

SEQ ID NO: 1961 - RNA, 21 nt, Artificial Sequence
  Synthetic construct
cuagaagauuguugagaccaa

SEQ ID NO: 1962 - RNA, 21 nt, Artificial Sequence
  Synthetic construct
aaggacguagaauaccaauag

SEQ ID NO: 1963 - RNA, 21 nt, Artificial Sequence
  Synthetic construct
ucuuucucaaauugguaauaa

SEQ ID NO: 1964 - RNA, 21 nt, Artificial Sequence
  Synthetic construct
ucucugaugccuuaucccaaa

SEQ ID NO: 1965 - RNA, 21 nt, Artificial Sequence
  Synthetic construct
uccaugcacgcugaccagccc

SEQ ID NO: 1966 - RNA, 21 nt, Artificial Sequence
  Synthetic construct
auugcucuuguuaaagaaggc

SEQ ID NO: 1967 - RNA, 21 nt, Artificial Sequence
  Synthetic construct
ggaacuucucagaaucuugga

SEQ ID NO: 1968 - RNA, 21 nt, Artificial Sequence
  Synthetic construct
ugcgucauucucagcucuuaa

SEQ ID NO: 1969 - RNA, 21 nt, Artificial Sequence
  Synthetic construct
uuucucaaauugguaauaaga

SEQ ID NO: 1970 - RNA, 21 nt, Artificial Sequence
  Synthetic construct
aucguccaggagauagauguc

SEQ ID NO: 1971 - RNA, 21 nt, Artificial Sequence
  Synthetic construct
ugcagugguccugcccacagg

SEQ ID NO: 1972 - RNA, 21 nt, Artificial Sequence
  Synthetic construct
gucuggauucuucggaugcug

SEQ ID NO: 1973 - RNA, 21 nt, Artificial Sequence
  Synthetic construct
ugacgauugccucugacaccc

SEQ ID NO: 1974 - RNA, 21 nt, Artificial Sequence
  Synthetic construct
aauaaauuccuaaguaccagu

SEQ ID NO: 1975 - RNA, 21 nt, Artificial Sequence
  Synthetic construct
agcaccaucuuucaaggaggg

SEQ ID NO: 1976 - RNA, 21 nt, Artificial Sequence
  Synthetic construct
guaagaacacugucaccugau

SEQ ID NO: 1977 - RNA, 21 nt, Artificial Sequence
  Synthetic construct
ucuugcaagguuuacccgugc

SEQ ID NO: 1978 - RNA, 21 nt, Artificial Sequence
  Synthetic construct
agguuguucacuuuccucauu

SEQ ID NO: 1979 - RNA, 21 nt, Artificial Sequence
  Synthetic construct
gcaucuugauacacugcucuu

SEQ ID NO: 1980 - RNA, 21 nt, Artificial Sequence
  Synthetic construct
acaguucgaacaagugucugc

SEQ ID NO: 1981 - RNA, 21 nt, Artificial Sequence
  Synthetic construct
agcaaaucauccaagugucca

SEQ ID NO: 1982 - RNA, 21 nt, Artificial Sequence
  Synthetic construct
uagguggugaaggucacaaac

SEQ ID NO: 1983 - RNA, 21 nt, Artificial Sequence
  Synthetic construct
cagaguucccgagaacaccca

SEQ ID NO: 1984 - RNA, 21 nt, Artificial Sequence
  Synthetic construct
uguugagaccaaaccgaagac

SEQ ID NO: 1985 - RNA, 21 nt, Artificial Sequence
  Synthetic construct
accaauagagaucuugcuaug

SEQ ID NO: 1986 - RNA, 21 nt, Artificial Sequence
  Synthetic construct
caguucgaacaagugucugcu

SEQ ID NO: 1987 - RNA, 21 nt, Artificial Sequence
  Synthetic construct
aaagaauaauaccggagcuuu

SEQ ID NO: 1988 - RNA, 21 nt, Artificial Sequence
  Synthetic construct
uggauucuucggaugcugacg

SEQ ID NO: 1989 - RNA, 21 nt, Artificial Sequence
  Synthetic construct
aucuagcuucucgguuacauu

SEQ ID NO: 1990 - RNA, 21 nt, Artificial Sequence
  Synthetic construct
auaauaccggagcuuucagaa

SEQ ID NO: 1991 - RNA, 21 nt, Artificial Sequence
  Synthetic construct
gugacauuuagcauacuuugu

SEQ ID NO: 1992 - RNA, 21 nt, Artificial Sequence
  Synthetic construct
ucauuggacagcagauugacu

SEQ ID NO: 1993 - RNA, 21 nt, Artificial Sequence
  Synthetic construct
cugcacugagaggaucgucca

SEQ ID NO: 1994 - RNA, 21 nt, Artificial Sequence
  Synthetic construct
uaugauugcucuuguuaaaga

SEQ ID NO: 1995 - RNA, 21 nt, Artificial Sequence
  Synthetic construct
aucuugaagcacauaggcaac

SEQ ID NO: 1996 - RNA, 21 nt, Artificial Sequence
  Synthetic construct
ucuacugcacugagaggaucg

SEQ ID NO: 1997 - RNA, 21 nt, Artificial Sequence
  Synthetic construct
uguccaaugucuuuggagaaa

SEQ ID NO: 1998 - RNA, 21 nt, Artificial Sequence
  Synthetic construct
aguaccaguuaagaucuagcu

SEQ ID NO: 1999 - RNA, 21 nt, Artificial Sequence
  Synthetic construct
cuuagugugggaguuccugga

SEQ ID NO: 2000 - RNA, 21 nt, Artificial Sequence
  Synthetic construct
ugauugcucuuguuaaagaag

SEQ ID NO: 2001 - RNA, 21 nt, Artificial Sequence
  Synthetic construct
caaauugguaauaagauuuga

SEQ ID NO: 2002 - RNA, 21 nt, Artificial Sequence
  Synthetic construct
gauagaugucagcaucuugau

SEQ ID NO: 2003 - RNA, 21 nt, Artificial Sequence
  Synthetic construct
uacuccucagaguucccgaga

SEQ ID NO: 2004 - RNA, 21 nt, Artificial Sequence
  Synthetic construct
ucuucggaugcugacgauugc

SEQ ID NO: 2005 - RNA, 21 nt, Artificial Sequence
  Synthetic construct
gaagcacauaggcaacaucuu

SEQ ID NO: 2006 - RNA, 21 nt, Artificial Sequence
  Synthetic construct
gaagacucugagaagguacga

SEQ ID NO: 2007 - RNA, 21 nt, Artificial Sequence
  Synthetic construct
cugugcgucauucucagcucu

SEQ ID NO: 2008 - RNA, 21 nt, Artificial Sequence
  Synthetic construct
agagcaccaucuuucaaggag

SEQ ID NO: 2009 - RNA, 21 nt, Artificial Sequence
  Synthetic construct
gacauuuagcauacuuuguuu

SEQ ID NO: 2010 - RNA, 21 nt, Artificial Sequence
  Synthetic construct
cugccgaggagcacguaggug

SEQ ID NO: 2011 - RNA, 21 nt, Artificial Sequence
  Synthetic construct
cuccaacagcuguaaauccuu

SEQ ID NO: 2012 - RNA, 21 nt, Artificial Sequence
  Synthetic construct
auugguaauaagauuugaaaa

SEQ ID NO: 2013 - RNA, 21 nt, Artificial Sequence
  Synthetic construct
cagaauugacucaaacauuuu

SEQ ID NO: 2014 - RNA, 21 nt, Artificial Sequence
  Synthetic construct
cuaucacagucagaucaccau

SEQ ID NO: 2015 - RNA, 21 nt, Artificial Sequence
  Synthetic construct
cugugauaucucaucaaguag

SEQ ID NO: 2016 - RNA, 21 nt, Artificial Sequence
  Synthetic construct
agauagaugucagcaucuuga

SEQ ID NO: 2017 - RNA, 21 nt, Artificial Sequence
  Synthetic construct
auuauccuuauaccaguuaua

SEQ ID NO: 2018 - RNA, 21 nt, Artificial Sequence
  Synthetic construct
agaacccuugcaacuccucuc

SEQ ID NO: 2019 - RNA, 21 nt, Artificial Sequence
  Synthetic construct
auaccggagcuuucagaauug

SEQ ID NO: 2020 - RNA, 21 nt, Artificial Sequence
  Synthetic construct
acgcgugagcagagguucgcg

SEQ ID NO: 2021 - RNA, 21 nt, Artificial Sequence
  Synthetic construct
acaaggacguagaauaccaau

SEQ ID NO: 2022 - RNA, 21 nt, Artificial Sequence
  Synthetic construct
gugaaggucacaaacacgaug

SEQ ID NO: 2023 - RNA, 21 nt, Artificial Sequence
  Synthetic construct
aaggccuuguagaguuggggu

SEQ ID NO: 2024 - RNA, 21 nt, Artificial Sequence
  Synthetic construct
aaccgucagccgcacagcccc

SEQ ID NO: 2025 - RNA, 21 nt, Artificial Sequence
  Synthetic construct
gagauagaugucagcaucuug

SEQ ID NO: 2026 - RNA, 21 nt, Artificial Sequence
  Synthetic construct
aaaccugaauaaauuccuaag

SEQ ID NO: 2027 - RNA, 21 nt, Artificial Sequence
  Synthetic construct
acgaagugccucaauuaacgu

SEQ ID NO: 2028 - RNA, 21 nt, Artificial Sequence
  Synthetic construct
ucguauuucuucccaaauaaa

SEQ ID NO: 2029 - RNA, 21 nt, Artificial Sequence
  Synthetic construct
ucgcgcugaucaggcggcggu

SEQ ID NO: 2030 - RNA, 21 nt, Artificial Sequence
  Synthetic construct
ugcugagacacauaggcaauu

SEQ ID NO: 2031 - RNA, 21 nt, Artificial Sequence
  Synthetic construct
agaggguaaccgucagccgca

SEQ ID NO: 2032 - RNA, 21 nt, Artificial Sequence
  Synthetic construct
gaucaaacuuguucacaucau

SEQ ID NO: 2033 - RNA, 21 nt, Artificial Sequence
  Synthetic construct
ugugcaaaguuugugaagagu

SEQ ID NO: 2034 - RNA, 21 nt, Artificial Sequence
  Synthetic construct
cagcaaggcacgauauuccua

SEQ ID NO: 2035 - RNA, 21 nt, Artificial Sequence
  Synthetic construct
uuauaacuucauucauggucc

SEQ ID NO: 2036 - RNA, 21 nt, Artificial Sequence
  Synthetic construct
uucgaacaagugucugcuaac

SEQ ID NO: 2037 - RNA, 21 nt, Artificial Sequence
  Synthetic construct
uuucaaggagggucuagaaga

SEQ ID NO: 2038 - RNA, 21 nt, Artificial Sequence
  Synthetic construct
acagcuuugcaagggcaggag

SEQ ID NO: 2039 - RNA, 21 nt, Artificial Sequence
  Synthetic construct
gugaugacuucccugcuccca

SEQ ID NO: 2040 - RNA, 21 nt, Artificial Sequence
  Synthetic construct
uagugugggaguuccuggaac

SEQ ID NO: 2041 - RNA, 21 nt, Artificial Sequence
  Synthetic construct
ugugaagaguuaacaaggacg

SEQ ID NO: 2042 - RNA, 21 nt, Artificial Sequence
  Synthetic construct
caaauacacaguucgaacaag

SEQ ID NO: 2043 - RNA, 21 nt, Artificial Sequence
  Synthetic construct
auaccaguuauaacuucauuc

SEQ ID NO: 2044 - RNA, 21 nt, Artificial Sequence
  Synthetic construct
auauuccuaucuccauccaga

SEQ ID NO: 2045 - RNA, 21 nt, Artificial Sequence
  Synthetic construct
aagaagaggguaaccgucagc

SEQ ID NO: 2046 - RNA, 21 nt, Artificial Sequence
  Synthetic construct
ugcaacuccucuccaaggugc

SEQ ID NO: 2047 - RNA, 21 nt, Artificial Sequence
  Synthetic construct
guuacuaagacgaagugccuc

SEQ ID NO: 2048 - RNA, 21 nt, Artificial Sequence
  Synthetic construct
acgccuguccgcucggcugga

SEQ ID NO: 2049 - RNA, 21 nt, Artificial Sequence
  Synthetic construct
cauccaaguguccaaugucuu

SEQ ID NO: 2050 - RNA, 21 nt, Artificial Sequence
  Synthetic construct
accgucagccgcacagcccca

SEQ ID NO: 2051 - RNA, 21 nt, Artificial Sequence
  Synthetic construct
cauuggacagcagauugacua

SEQ ID NO: 2052 - RNA, 21 nt, Artificial Sequence
  Synthetic construct
uguucacaucauuggacagca

SEQ ID NO: 2053 - RNA, 21 nt, Artificial Sequence
  Synthetic construct
accugaauaaauuccuaagua

SEQ ID NO: 2054 - RNA, 21 nt, Artificial Sequence
  Synthetic construct
auuggauuucuaucaaagaau

SEQ ID NO: 2055 - RNA, 21 nt, Artificial Sequence
  Synthetic construct
uuuguuugcccaguaugaaag

SEQ ID NO: 2056 - RNA, 21 nt, Artificial Sequence
  Synthetic construct
caaggugcugugagcggucuu

SEQ ID NO: 2057 - RNA, 21 nt, Artificial Sequence
  Synthetic construct
aacuggagguuguucacuuuc

SEQ ID NO: 2058 - RNA, 21 nt, Artificial Sequence
  Synthetic construct
gugcugugagcggucuucugg

SEQ ID NO: 2059 - RNA, 21 nt, Artificial Sequence
  Synthetic construct
cuacugcacugagaggaucgu

SEQ ID NO: 2060 - RNA, 21 nt, Artificial Sequence
  Synthetic construct
ucccgagaacacccagggcug

SEQ ID NO: 2061 - RNA, 21 nt, Artificial Sequence
  Synthetic construct
aaccgaagacucugagaaggu

SEQ ID NO: 2062 - RNA, 21 nt, Artificial Sequence
  Synthetic construct
aaauacacaguucgaacaagu

SEQ ID NO: 2063 - RNA, 21 nt, Artificial Sequence
  Synthetic construct
uucucagaaucuuggaaaucu

SEQ ID NO: 2064 - RNA, 21 nt, Artificial Sequence
  Synthetic construct
auucaucccucugaggcagga

SEQ ID NO: 2065 - RNA, 21 nt, Artificial Sequence
  Synthetic construct
accucaagcagggaugcuggg

SEQ ID NO: 2066 - RNA, 21 nt, Artificial Sequence
  Synthetic construct
gacacauaggcaauucuucca

SEQ ID NO: 2067 - RNA, 21 nt, Artificial Sequence
  Synthetic construct
ucagagcacaagccuuuauga

SEQ ID NO: 2068 - RNA, 21 nt, Artificial Sequence
  Synthetic construct
acuaaauaagauuuccaguaa

SEQ ID NO: 2069 - RNA, 21 nt, Artificial Sequence
  Synthetic construct
aguuccuggaacuggagguug

SEQ ID NO: 2070 - RNA, 21 nt, Artificial Sequence
  Synthetic construct
cagaguagggcagucacugca

SEQ ID NO: 2071 - RNA, 21 nt, Artificial Sequence
  Synthetic construct
gucucugaugccuuaucccaa

SEQ ID NO: 2072 - RNA, 21 nt, Artificial Sequence
  Synthetic construct
caucuuucaaggagggucuag

SEQ ID NO: 2073 - RNA, 21 nt, Artificial Sequence
  Synthetic construct
ccaucuuucaaggagggucua

SEQ ID NO: 2074 - RNA, 21 nt, Artificial Sequence
  Synthetic construct
uacuccucagugaugagaaca

SEQ ID NO: 2075 - RNA, 21 nt, Artificial Sequence
  Synthetic construct
aaccugaauaaauuccuaagu

SEQ ID NO: 2076 - RNA, 21 nt, Artificial Sequence
  Synthetic construct
auuucuaucaaagaauaauac

SEQ ID NO: 2077 - RNA, 21 nt, Artificial Sequence
  Synthetic construct
cgguagcuacaguuaaaccug

SEQ ID NO: 2078 - RNA, 21 nt, Artificial Sequence
  Synthetic construct
gaagaagaggguaaccgucag

SEQ ID NO: 2079 - RNA, 21 nt, Artificial Sequence
  Synthetic construct
uccaaggugcugugagcgguc

SEQ ID NO: 2080 - RNA, 21 nt, Artificial Sequence
  Synthetic construct
uguuaaagaaggcuucugugc

SEQ ID NO: 2081 - RNA, 21 nt, Artificial Sequence
  Synthetic construct
acgcugaccagcccgugacuu

SEQ ID NO: 2082 - RNA, 21 nt, Artificial Sequence
  Synthetic construct
aagacgaagugccucaauuaa

SEQ ID NO: 2083 - RNA, 21 nt, Artificial Sequence
  Synthetic construct
aggacguagaauaccaauaga

SEQ ID NO: 2084 - RNA, 21 nt, Artificial Sequence
  Synthetic construct
uauccuuauaccaguuauaac

SEQ ID NO: 2085 - RNA, 21 nt, Artificial Sequence
  Synthetic construct
gcugcugagacacauaggcaa

SEQ ID NO: 2086 - RNA, 21 nt, Artificial Sequence
  Synthetic construct
caccugaucaaacuuguucac

SEQ ID NO: 2087 - RNA, 21 nt, Artificial Sequence
  Synthetic construct
gagguucgcguccugcagcgg

SEQ ID NO: 2088 - RNA, 21 nt, Artificial Sequence
  Synthetic construct
ugugauaucucaucaaguagc

SEQ ID NO: 2089 - RNA, 21 nt, Artificial Sequence
  Synthetic construct
cacugucaccugaucaaacuu

SEQ ID NO: 2090 - RNA, 21 nt, Artificial Sequence
  Synthetic construct
cuuuccucauuauccuucuuu

SEQ ID NO: 2091 - RNA, 21 nt, Artificial Sequence
  Synthetic construct
uccacucagcgugguuccccg

SEQ ID NO: 2092 - RNA, 21 nt, Artificial Sequence
  Synthetic construct
agagguucgcguccugcagcg

SEQ ID NO: 2093 - RNA, 21 nt, Artificial Sequence
  Synthetic construct
cuuccgcaucuacugcacuga

SEQ ID NO: 2094 - RNA, 21 nt, Artificial Sequence
  Synthetic construct
gucacaaacacgaugauuuug

SEQ ID NO: 2095 - RNA, 21 nt, Artificial Sequence
  Synthetic construct
ccaaucuugaagcacauaggc

SEQ ID NO: 2096 - RNA, 21 nt, Artificial Sequence
  Synthetic construct
cacugaauacauaucaucuuc

SEQ ID NO: 2097 - RNA, 21 nt, Artificial Sequence
  Synthetic construct
accaguuaagaucuagcuucu

SEQ ID NO: 2098 - RNA, 21 nt, Artificial Sequence
  Synthetic construct
agggcagucacugcaaucgcc

SEQ ID NO: 2099 - RNA, 21 nt, Artificial Sequence
  Synthetic construct
aaauaagauuuccaguaacac

SEQ ID NO: 2100 - RNA, 21 nt, Artificial Sequence
  Synthetic construct
agcacguagguggugaagguc

SEQ ID NO: 2101 - RNA, 21 nt, Artificial Sequence
  Synthetic construct
gaaucugacuugcagcuuuga

SEQ ID NO: 2102 - RNA, 21 nt, Artificial Sequence
  Synthetic construct
gucagcaucuugauacacugc

SEQ ID NO: 2103 - RNA, 21 nt, Artificial Sequence
  Synthetic construct
aagaauaauaccggagcuuuc

SEQ ID NO: 2104 - RNA, 21 nt, Artificial Sequence
  Synthetic construct
agauuuccaguaacacuuuau

SEQ ID NO: 2105 - RNA, 21 nt, Artificial Sequence
  Synthetic construct
acaucauuggacagcagauug

SEQ ID NO: 2106 - RNA, 21 nt, Artificial Sequence
  Synthetic construct
uccucuaaucuccguuuaugg

SEQ ID NO: 2107 - RNA, 21 nt, Artificial Sequence
  Synthetic construct
agaccaaaccgaagacucuga

SEQ ID NO: 2108 - RNA, 21 nt, Artificial Sequence
  Synthetic construct
cuucaccuccugguacacggg

SEQ ID NO: 2109 - RNA, 21 nt, Artificial Sequence
  Synthetic construct
uuuggagaaacgauuuaaaau

SEQ ID NO: 2110 - RNA, 21 nt, Artificial Sequence
  Synthetic construct
ucgcguccugcagcggguugg

SEQ ID NO: 2111 - RNA, 21 nt, Artificial Sequence
  Synthetic construct
acugccgaggagcacguaggu

SEQ ID NO: 2112 - RNA, 21 nt, Artificial Sequence
  Synthetic construct
agguacgauuccuuagugugg

SEQ ID NO: 2113 - RNA, 21 nt, Artificial Sequence
  Synthetic construct
cuugcaacuccucuccaaggu

SEQ ID NO: 2114 - RNA, 21 nt, Artificial Sequence
  Synthetic construct
ucuuuaucccagaacccuugc

SEQ ID NO: 2115 - RNA, 21 nt, Artificial Sequence
  Synthetic construct
gaaguguaagaacacugucac

SEQ ID NO: 2116 - RNA, 21 nt, Artificial Sequence
  Synthetic construct
cuggagguuguucacuuuccu

SEQ ID NO: 2117 - RNA, 21 nt, Artificial Sequence
  Synthetic construct
uaucccagaacccuugcaacu

SEQ ID NO: 2118 - RNA, 21 nt, Artificial Sequence
  Synthetic construct
gguagcuacaguuaaaccuga

SEQ ID NO: 2119 - RNA, 21 nt, Artificial Sequence
  Synthetic construct
augucagcaucuugauacacu

SEQ ID NO: 2120 - RNA, 21 nt, Artificial Sequence
  Synthetic construct
ccaguuaagaucuagcuucuc

SEQ ID NO: 2121 - RNA, 21 nt, Artificial Sequence
  Synthetic construct
cuccaaggugcugugagcggu

SEQ ID NO: 2122 - RNA, 21 nt, Artificial Sequence
  Synthetic construct
caguaacacuuuaugauugcu

SEQ ID NO: 2123 - RNA, 21 nt, Artificial Sequence
  Synthetic construct
auccagaguagggcagucacu

SEQ ID NO: 2124 - RNA, 21 nt, Artificial Sequence
  Synthetic construct
gugaagaguuaacaaggacgu

SEQ ID NO: 2125 - RNA, 21 nt, Artificial Sequence
  Synthetic construct
ggacagcagauugacuaucug

SEQ ID NO: 2126 - RNA, 21 nt, Artificial Sequence
  Synthetic construct
gugagcagagguucgcguccu

SEQ ID NO: 2127 - RNA, 21 nt, Artificial Sequence
  Synthetic construct
cucugaggcaggaacuucuca

SEQ ID NO: 2128 - RNA, 21 nt, Artificial Sequence
  Synthetic construct
caauucuuccaugcacgcuga

SEQ ID NO: 2129 - RNA, 21 nt, Artificial Sequence
  Synthetic construct
gaaggucacaaacacgaugau

SEQ ID NO: 2130 - RNA, 21 nt, Artificial Sequence
  Synthetic construct
aggagaaugauuagaacugcc

SEQ ID NO: 2131 - RNA, 21 nt, Artificial Sequence
  Synthetic construct
caggaaguguaagaacacugu

SEQ ID NO: 2132 - RNA, 21 nt, Artificial Sequence
  Synthetic construct
agaagaacacgcgugagcaga

SEQ ID NO: 2133 - RNA, 21 nt, Artificial Sequence
  Synthetic construct
gaacuggagguuguucacuuu

SEQ ID NO: 2134 - RNA, 21 nt, Artificial Sequence
  Synthetic construct
cgaagugccucaauuaacgua

SEQ ID NO: 2135 - RNA, 21 nt, Artificial Sequence
  Synthetic construct
accauccuccaacagcuguaa

SEQ ID NO: 2136 - RNA, 21 nt, Artificial Sequence
  Synthetic construct
cauccgugaaaguugcaguuu

SEQ ID NO: 2137 - RNA, 21 nt, Artificial Sequence
  Synthetic construct
aucgccugcagugguccugcc

SEQ ID NO: 2138 - RNA, 21 nt, Artificial Sequence
  Synthetic construct
ccgaggagcacguagguggug

SEQ ID NO: 2139 - RNA, 21 nt, Artificial Sequence
  Synthetic construct
cugcacaugcaccaucuuuuu

SEQ ID NO: 2140 - RNA, 21 nt, Artificial Sequence
  Synthetic construct
acuuuguuuguuugcccagua

SEQ ID NO: 2141 - RNA, 21 nt, Artificial Sequence
  Synthetic construct
gaugucagcaucuugauacac

SEQ ID NO: 2142 - RNA, 21 nt, Artificial Sequence
  Synthetic construct
gagguuguucacuuuccucau

SEQ ID NO: 2143 - RNA, 21 nt, Artificial Sequence
  Synthetic construct
uuaucccagaacccuugcaac

SEQ ID NO: 2144 - RNA, 21 nt, Artificial Sequence
  Synthetic construct
aauugguaauaagauuugaaa

SEQ ID NO: 2145 - RNA, 21 nt, Artificial Sequence
  Synthetic construct
uccuaucacagucagaucacc

SEQ ID NO: 2146 - RNA, 21 nt, Artificial Sequence
  Synthetic construct
cugacaguaaaggaaaggccu

SEQ ID NO: 2147 - RNA, 21 nt, Artificial Sequence
  Synthetic construct
caucauuggacagcagauuga

SEQ ID NO: 2148 - RNA, 21 nt, Artificial Sequence
  Synthetic construct
accaaucuugaagcacauagg

SEQ ID NO: 2149 - RNA, 21 nt, Artificial Sequence
  Synthetic construct
agaucuagcuucucgguuaca

SEQ ID NO: 2150 - RNA, 21 nt, Artificial Sequence
  Synthetic construct
uacccgugcuuucugcccucc

SEQ ID NO: 2151 - RNA, 21 nt, Artificial Sequence
  Synthetic construct
cuguccgcucggcuggagccu

SEQ ID NO: 2152 - RNA, 21 nt, Artificial Sequence
  Synthetic construct
aaggugcugugagcggucuuc

SEQ ID NO: 2153 - RNA, 21 nt, Artificial Sequence
  Synthetic construct
aauuccuaaguaccaguuaag

SEQ ID NO: 2154 - RNA, 21 nt, Artificial Sequence
  Synthetic construct
acugaauacauaucaucuucc

SEQ ID NO: 2155 - RNA, 21 nt, Artificial Sequence
  Synthetic construct
gcucuugcaagguuuacccgu

SEQ ID NO: 2156 - RNA, 21 nt, Artificial Sequence
  Synthetic construct
gaauacauaucaucuuccucu

SEQ ID NO: 2157 - RNA, 21 nt, Artificial Sequence
  Synthetic construct
ucugcccuccacucagcgugg

SEQ ID NO: 2158 - RNA, 21 nt, Artificial Sequence
  Synthetic construct
ucuuccuauuggauuucuauc

SEQ ID NO: 2159 - RNA, 21 nt, Artificial Sequence
  Synthetic construct
uggacagcagauugacuaucu

SEQ ID NO: 2160 - RNA, 21 nt, Artificial Sequence
  Synthetic construct
caaugucuuuggagaaacgau

SEQ ID NO: 2161 - RNA, 21 nt, Artificial Sequence
  Synthetic construct
uuccaugcacgcugaccagcc

SEQ ID NO: 2162 - RNA, 21 nt, Artificial Sequence
  Synthetic construct
agaacacccagggcugcugag

SEQ ID NO: 2163 - RNA, 21 nt, Artificial Sequence
  Synthetic construct
ugugaucuucucaugcaaaau

SEQ ID NO: 2164 - RNA, 21 nt, Artificial Sequence
  Synthetic construct
acgggcagcaucuugccgggc

SEQ ID NO: 2165 - RNA, 21 nt, Artificial Sequence
  Synthetic construct
gaacaagugucugcuaacuuc

SEQ ID NO: 2166 - RNA, 21 nt, Artificial Sequence
  Synthetic construct
ugccucugacacccucucaau

SEQ ID NO: 2167 - RNA, 21 nt, Artificial Sequence
  Synthetic construct
ccaugcacgcugaccagcccg

SEQ ID NO: 2168 - RNA, 21 nt, Artificial Sequence
  Synthetic construct
aaggaaaggccuuguagaguu

SEQ ID NO: 2169 - RNA, 21 nt, Artificial Sequence
  Synthetic construct
caccauccuccaacagcugua

SEQ ID NO: 2170 - RNA, 21 nt, Artificial Sequence
  Synthetic construct
cgaacaagugucugcuaacuu

SEQ ID NO: 2171 - RNA, 21 nt, Artificial Sequence
  Synthetic construct
gaagaggguaaccgucagccg

SEQ ID NO: 2172 - RNA, 21 nt, Artificial Sequence
  Synthetic construct
acuccucuccaaggugcugug

SEQ ID NO: 2173 - RNA, 21 nt, Artificial Sequence
  Synthetic construct
gaaucuuggaaaucuccuucu

SEQ ID NO: 2174 - RNA, 21 nt, Artificial Sequence
  Synthetic construct
cagcggcagcaaaucauccaa

SEQ ID NO: 2175 - RNA, 21 nt, Artificial Sequence
  Synthetic construct
aagggcaggagaaugauuaga

SEQ ID NO: 2176 - RNA, 21 nt, Artificial Sequence
  Synthetic construct
auaucucaucaaguagcaaaa

SEQ ID NO: 2177 - RNA, 21 nt, Artificial Sequence
  Synthetic construct
uuugcaagggcaggagaauga

SEQ ID NO: 2178 - RNA, 21 nt, Artificial Sequence
  Synthetic construct
aaaucauccaaguguccaaug

SEQ ID NO: 2179 - RNA, 21 nt, Artificial Sequence
  Synthetic construct
cgauauuccuaucuccaucca

SEQ ID NO: 2180 - RNA, 21 nt, Artificial Sequence
  Synthetic construct
uaaauaagauuuccaguaaca

SEQ ID NO: 2181 - RNA, 21 nt, Artificial Sequence
  Synthetic construct
cuugaagcacauaggcaacau

SEQ ID NO: 2182 - RNA, 21 nt, Artificial Sequence
  Synthetic construct
aggaaaggccuuguagaguug

SEQ ID NO: 2183 - RNA, 21 nt, Artificial Sequence
  Synthetic construct
ugcacgcugaccagcccguga

SEQ ID NO: 2184 - RNA, 21 nt, Artificial Sequence
  Synthetic construct
ucccucugaggcaggaacuuc

SEQ ID NO: 2185 - RNA, 21 nt, Artificial Sequence
  Synthetic construct
acacugcucuugcaagguuua

SEQ ID NO: 2186 - RNA, 21 nt, Artificial Sequence
  Synthetic construct
caggagaaugauuagaacugc

SEQ ID NO: 2187 - RNA, 21 nt, Artificial Sequence
  Synthetic construct
cacauaggcaauucuuccaug

SEQ ID NO: 2188 - RNA, 21 nt, Artificial Sequence
  Synthetic construct
gcaucuacugcacugagagga

SEQ ID NO: 2189 - RNA, 21 nt, Artificial Sequence
  Synthetic construct
cacugcaaucgccugcagugg

SEQ ID NO: 2190 - RNA, 21 nt, Artificial Sequence
  Synthetic construct
gaacacugucaccugaucaaa

SEQ ID NO: 2191 - RNA, 21 nt, Artificial Sequence
  Synthetic construct
aaggcuucugugcgucauucu

SEQ ID NO: 2192 - RNA, 21 nt, Artificial Sequence
  Synthetic construct
guguccaaugucuuuggagaa

SEQ ID NO: 2193 - RNA, 21 nt, Artificial Sequence
  Synthetic construct
aucccagaacccuugcaacuc

SEQ ID NO: 2194 - RNA, 21 nt, Artificial Sequence
  Synthetic construct
ucagaguucccgagaacaccc

SEQ ID NO: 2195 - RNA, 21 nt, Artificial Sequence
  Synthetic construct
ccaaugucuuuggagaaacga

SEQ ID NO: 2196 - RNA, 21 nt, Artificial Sequence
  Synthetic construct
acgucagcggcagcaaaucau

SEQ ID NO: 2197 - RNA, 21 nt, Artificial Sequence
  Synthetic construct
agaacgguagcuacaguuaaa

SEQ ID NO: 2198 - RNA, 21 nt, Artificial Sequence
  Synthetic construct
gaccaaaccgaagacucugag

SEQ ID NO: 2199 - RNA, 21 nt, Artificial Sequence
  Synthetic construct
gaacacgcgugagcagagguu

SEQ ID NO: 2200 - RNA, 21 nt, Artificial Sequence
  Synthetic construct
cucuugcaagguuuacccgug

SEQ ID NO: 2201 - RNA, 21 nt, Artificial Sequence
  Synthetic construct
cagugaugagaacaacuuccc

SEQ ID NO: 2202 - RNA, 21 nt, Artificial Sequence
  Synthetic construct
aacacgcgugagcagagguuc

SEQ ID NO: 2203 - RNA, 21 nt, Artificial Sequence
  Synthetic construct
gugauaucucaucaaguagca

SEQ ID NO: 2204 - RNA, 21 nt, Artificial Sequence
  Synthetic construct
gcaggaacuucucagaaucuu

SEQ ID NO: 2205 - RNA, 21 nt, Artificial Sequence
  Synthetic construct
cuuuaucccagaacccuugca

SEQ ID NO: 2206 - RNA, 21 nt, Artificial Sequence
  Synthetic construct
accaucuuucaauaucagaau

SEQ ID NO: 2207 - RNA, 21 nt, Artificial Sequence
  Synthetic construct
accugaucaaacuuguucaca

SEQ ID NO: 2208 - RNA, 21 nt, Artificial Sequence
  Synthetic construct
aauaccggagcuuucagaauu

SEQ ID NO: 2209 - RNA, 21 nt, Artificial Sequence
  Synthetic construct
uauaucucuauggaucaccug

SEQ ID NO: 2210 - RNA, 21 nt, Artificial Sequence
  Synthetic construct
uuaucuugcaaguucaaccca

SEQ ID NO: 2211 - RNA, 21 nt, Artificial Sequence
  Synthetic construct
uuagguaucauuaucuuuguu

SEQ ID NO: 2212 - RNA, 21 nt, Artificial Sequence
  Synthetic construct
uaauguaucuauuuccuccug

SEQ ID NO: 2213 - RNA, 21 nt, Artificial Sequence
  Synthetic construct
uaauuugucaacauuucucaa

SEQ ID NO: 2214 - RNA, 21 nt, Artificial Sequence
  Synthetic construct
uuuacaaugacacacacacga

SEQ ID NO: 2215 - RNA, 21 nt, Artificial Sequence
  Synthetic construct
uucuguauugagaaugaccaa

SEQ ID NO: 2216 - RNA, 21 nt, Artificial Sequence
  Synthetic construct
auuaaggagauuaacaaccug

SEQ ID NO: 2217 - RNA, 21 nt, Artificial Sequence
  Synthetic construct
ucuaauagugacaucucccua

SEQ ID NO: 2218 - RNA, 21 nt, Artificial Sequence
  Synthetic construct
uuaauauuaaacacauuccca

SEQ ID NO: 2219 - RNA, 21 nt, Artificial Sequence
  Synthetic construct
uuacaaugacacacacacgag

SEQ ID NO: 2220 - RNA, 21 nt, Artificial Sequence
  Synthetic construct
uaaauaaucucuacugugcuu

SEQ ID NO: 2221 - RNA, 21 nt, Artificial Sequence
  Synthetic construct
uuaacugaauauuaacugcaa

SEQ ID NO: 2222 - RNA, 21 nt, Artificial Sequence
  Synthetic construct
uucauuaauaauuaauuccuu

SEQ ID NO: 2223 - RNA, 21 nt, Artificial Sequence
  Synthetic construct
uucucuacuaucgcuguugau

SEQ ID NO: 2224 - RNA, 21 nt, Artificial Sequence
  Synthetic construct
acaacuacugcaaacaaccua

SEQ ID NO: 2225 - RNA, 21 nt, Artificial Sequence
  Synthetic construct
uugagugcugaagaaucccgg

SEQ ID NO: 2226 - RNA, 21 nt, Artificial Sequence
  Synthetic construct
uaauauuaaacacauucccaa

SEQ ID NO: 2227 - RNA, 21 nt, Artificial Sequence
  Synthetic construct
augauauacaguaauauccug

SEQ ID NO: 2228 - RNA, 21 nt, Artificial Sequence
  Synthetic construct
uaucuugcaaguucaacccaa

SEQ ID NO: 2229 - RNA, 21 nt, Artificial Sequence
  Synthetic construct
ucauucucuacuaucgcuguu

SEQ ID NO: 2230 - RNA, 21 nt, Artificial Sequence
  Synthetic construct
uucagaaccugaacucaccua

SEQ ID NO: 2231 - RNA, 21 nt, Artificial Sequence
  Synthetic construct
uuccugaacacacauauuccu

SEQ ID NO: 2232 - RNA, 21 nt, Artificial Sequence
  Synthetic construct
uauacagacaacaggaagcaa

SEQ ID NO: 2233 - RNA, 21 nt, Artificial Sequence
  Synthetic construct
uuaugggauagcauuugccug

SEQ ID NO: 2234 - RNA, 21 nt, Artificial Sequence
  Synthetic construct
uugcuguugaagguucaucug

SEQ ID NO: 2235 - RNA, 21 nt, Artificial Sequence
  Synthetic construct
uuuacagauaacacauucuga

SEQ ID NO: 2236 - RNA, 21 nt, Artificial Sequence
  Synthetic construct
uauagaaucucucagaacugg

SEQ ID NO: 2237 - RNA, 21 nt, Artificial Sequence
  Synthetic construct
uuagagaaacaacuuucugua

SEQ ID NO: 2238 - RNA, 21 nt, Artificial Sequence
  Synthetic construct
uaaguguuuagguucacucuu

SEQ ID NO: 2239 - RNA, 21 nt, Artificial Sequence
  Synthetic construct
ugauauuauagaaucucucag

SEQ ID NO: 2240 - RNA, 21 nt, Artificial Sequence
  Synthetic construct
uuaauaauuaauuccuucuug

SEQ ID NO: 2241 - RNA, 21 nt, Artificial Sequence
  Synthetic construct
uauuauuaucaaaucuuggua

SEQ ID NO: 2242 - RNA, 21 nt, Artificial Sequence
  Synthetic construct
uacuauaucaccuuucucuag

SEQ ID NO: 2243 - RNA, 21 nt, Artificial Sequence
  Synthetic construct
uugaguuaaaucuucuuacau

SEQ ID NO: 2244 - RNA, 21 nt, Artificial Sequence
  Synthetic construct
uagaauacucguacacacagg

SEQ ID NO: 2245 - RNA, 21 nt, Artificial Sequence
  Synthetic construct
uuuacauacagacuguaugga

SEQ ID NO: 2246 - RNA, 21 nt, Artificial Sequence
  Synthetic construct
uauuaugaacuucauuugcuu

SEQ ID NO: 2247 - RNA, 21 nt, Artificial Sequence
  Synthetic construct
uuugguuagauggucucccuu

SEQ ID NO: 2248 - RNA, 21 nt, Artificial Sequence
  Synthetic construct
uuugcaauacuuuagguccaa

SEQ ID NO: 2249 - RNA, 21 nt, Artificial Sequence
  Synthetic construct
uucuaauagugacaucucccu

SEQ ID NO: 2250 - RNA, 21 nt, Artificial Sequence
  Synthetic construct
uuauagaaucucucagaacug

SEQ ID NO: 2251 - RNA, 21 nt, Artificial Sequence
  Synthetic construct
uuucuuacagaguugaauguu

SEQ ID NO: 2252 - RNA, 21 nt, Artificial Sequence
  Synthetic construct
uaaggcuugcagucuuagcgg

SEQ ID NO: 2253 - RNA, 21 nt, Artificial Sequence
  Synthetic construct
uauaguuugcugaaacucuaa

SEQ ID NO: 2254 - RNA, 21 nt, Artificial Sequence
  Synthetic construct
uugccuagcgucacauagcaa

SEQ ID NO: 2255 - RNA, 21 nt, Artificial Sequence
  Synthetic construct
uaacuuauagauaauagucuc

SEQ ID NO: 2256 - RNA, 21 nt, Artificial Sequence
  Synthetic construct
uuauagauaauagucuccuaa

SEQ ID NO: 2257 - RNA, 21 nt, Artificial Sequence
  Synthetic construct
auuaacagaacuauaacugaa

SEQ ID NO: 2258 - RNA, 21 nt, Artificial Sequence
  Synthetic construct
uaaauaaauaaucucuacugu

SEQ ID NO: 2259 - RNA, 21 nt, Artificial Sequence
  Synthetic construct
uaaauuacauaaucugaggga

SEQ ID NO: 2260 - RNA, 21 nt, Artificial Sequence
  Synthetic construct
aaguuguauagaauacucgua

SEQ ID NO: 2261 - RNA, 21 nt, Artificial Sequence
  Synthetic construct
uuuaauauuaaacacauuccc

SEQ ID NO: 2262 - RNA, 21 nt, Artificial Sequence
  Synthetic construct
uagagaaacaacuuucuguaa

SEQ ID NO: 2263 - RNA, 21 nt, Artificial Sequence
  Synthetic construct
uauaauuauuuacacgaucuu

SEQ ID NO: 2264 - RNA, 21 nt, Artificial Sequence
  Synthetic construct
uguaacuagcaaauaucucug

SEQ ID NO: 2265 - RNA, 21 nt, Artificial Sequence
  Synthetic construct
uagacaaauaucucaaacuau

SEQ ID NO: 2266 - RNA, 21 nt, Artificial Sequence
  Synthetic construct
auuuacacgaucuuugagcug

SEQ ID NO: 2267 - RNA, 21 nt, Artificial Sequence
  Synthetic construct
auaauuaacaauauuaggguu

SEQ ID NO: 2268 - RNA, 21 nt, Artificial Sequence
  Synthetic construct
uuguugacuguuucuuuggaa

SEQ ID NO: 2269 - RNA, 21 nt, Artificial Sequence
  Synthetic construct
uuggguacuaaaucuguugaa

SEQ ID NO: 2270 - RNA, 21 nt, Artificial Sequence
  Synthetic construct
uuaauuugucaacauuucuca

SEQ ID NO: 2271 - RNA, 21 nt, Artificial Sequence
  Synthetic construct
ucuacugugcuucucacccuu

SEQ ID NO: 2272 - RNA, 21 nt, Artificial Sequence
  Synthetic construct
uauauuauuaucaaaucuugg

SEQ ID NO: 2273 - RNA, 21 nt, Artificial Sequence
  Synthetic construct
uaauuuagguaucauuaucuu

SEQ ID NO: 2274 - RNA, 21 nt, Artificial Sequence
  Synthetic construct
uuacuauucauccucagugga

SEQ ID NO: 2275 - RNA, 21 nt, Artificial Sequence
  Synthetic construct
uuaaggagauuaacaaccugg

SEQ ID NO: 2276 - RNA, 21 nt, Artificial Sequence
  Synthetic construct
uuugagaacaucuagaacagc

SEQ ID NO: 2277 - RNA, 21 nt, Artificial Sequence
  Synthetic construct
uacagaugaggaaacagccau

SEQ ID NO: 2278 - RNA, 21 nt, Artificial Sequence
  Synthetic construct
uuaauguaucuauuuccuccu

SEQ ID NO: 2279 - RNA, 21 nt, Artificial Sequence
  Synthetic construct
uggaauaauuguaacuagcaa

SEQ ID NO: 2280 - RNA, 21 nt, Artificial Sequence
  Synthetic construct
uucuauaacacaaauuguuag

SEQ ID NO: 2281 - RNA, 21 nt, Artificial Sequence
  Synthetic construct
uaacugaauauuaacugcaag

SEQ ID NO: 2282 - RNA, 21 nt, Artificial Sequence
  Synthetic construct
aagaccaagagauucaaccgg

SEQ ID NO: 2283 - RNA, 21 nt, Artificial Sequence
  Synthetic construct
uuaacaaccugguuuacucaa

SEQ ID NO: 2284 - RNA, 21 nt, Artificial Sequence
  Synthetic construct
uucucuauguuggucaggcug

SEQ ID NO: 2285 - RNA, 21 nt, Artificial Sequence
  Synthetic construct
uauuucugguuguugacuguu

SEQ ID NO: 2286 - RNA, 21 nt, Artificial Sequence
  Synthetic construct
aauauuaacugcaaguagcuu

SEQ ID NO: 2287 - RNA, 21 nt, Artificial Sequence
  Synthetic construct
uauugcuucaaccacaauuua

SEQ ID NO: 2288 - RNA, 21 nt, Artificial Sequence
  Synthetic construct
uuuauuuagauauacaguuuu

SEQ ID NO: 2289 - RNA, 21 nt, Artificial Sequence
  Synthetic construct
uuaacugcaaguagcuuagau

SEQ ID NO: 2290 - RNA, 21 nt, Artificial Sequence
  Synthetic construct
auagaauuugagaacaucuag

SEQ ID NO: 2291 - RNA, 21 nt, Artificial Sequence
  Synthetic construct
uuucauaggagaaauauucca

SEQ ID NO: 2292 - RNA, 21 nt, Artificial Sequence
  Synthetic construct
uuguuuaauauuaaacacauu

SEQ ID NO: 2293 - RNA, 21 nt, Artificial Sequence
  Synthetic construct
uuaacuuauagauaauagucu

SEQ ID NO: 2294 - RNA, 21 nt, Artificial Sequence
  Synthetic construct
uaucgcuguugauuuccucuu

SEQ ID NO: 2295 - RNA, 21 nt, Artificial Sequence
  Synthetic construct
uuacuauaucaccuuucucua

SEQ ID NO: 2296 - RNA, 21 nt, Artificial Sequence
  Synthetic construct
uagugcuucguuuacuuugcu

SEQ ID NO: 2297 - RNA, 21 nt, Artificial Sequence
  Synthetic construct
uauagcaggcugaauuugcaa

SEQ ID NO: 2298 - RNA, 21 nt, Artificial Sequence
  Synthetic construct
uuuggaaucauagaauuugag

SEQ ID NO: 2299 - RNA, 21 nt, Artificial Sequence
  Synthetic construct
uacuugaguuaaaucuucuua

SEQ ID NO: 2300 - RNA, 21 nt, Artificial Sequence
  Synthetic construct
uacauaguuguaaucccuguu

SEQ ID NO: 2301 - RNA, 21 nt, Artificial Sequence
  Synthetic construct
uacacuauauaguuugcugaa

SEQ ID NO: 2302 - RNA, 21 nt, Artificial Sequence
  Synthetic construct
aaucuguugaacauguugcca

SEQ ID NO: 2303 - RNA, 21 nt, Artificial Sequence
  Synthetic construct
uuguccuguugcaaugucuag

SEQ ID NO: 2304 - RNA, 21 nt, Artificial Sequence
  Synthetic construct
uaucucagggcacacuagcaa

SEQ ID NO: 2305 - RNA, 21 nt, Artificial Sequence
  Synthetic construct
ucuagcaagugugacagugug

SEQ ID NO: 2306 - RNA, 21 nt, Artificial Sequence
  Synthetic construct
uaaagcucauauuagacuccg

SEQ ID NO: 2307 - RNA, 21 nt, Artificial Sequence
  Synthetic construct
uuauauucuagcaagugugac

SEQ ID NO: 2308 - RNA, 21 nt, Artificial Sequence
  Synthetic construct
uuacccaacauggugacugau

SEQ ID NO: 2309 - RNA, 21 nt, Artificial Sequence
  Synthetic construct
uauuucagucuuacucaugag

SEQ ID NO: 2310 - RNA, 21 nt, Artificial Sequence
  Synthetic construct
ucuccugaacauaaacacgua

SEQ ID NO: 2311 - RNA, 21 nt, Artificial Sequence
  Synthetic construct
uuagauggauggauguaccuu

SEQ ID NO: 2312 - RNA, 21 nt, Artificial Sequence
  Synthetic construct
uuccuuugcagcgauaaucag

SEQ ID NO: 2313 - RNA, 21 nt, Artificial Sequence
  Synthetic construct
uaugacaacgcacuggauccu

SEQ ID NO: 2314 - RNA, 21 nt, Artificial Sequence
  Synthetic construct
uuacuuaauguccaacaagga

SEQ ID NO: 2315 - RNA, 21 nt, Artificial Sequence
  Synthetic construct
ucucucugcaacuuguaagug

SEQ ID NO: 2316 - RNA, 21 nt, Artificial Sequence
  Synthetic construct
uaugcucuggucuuggugcga

SEQ ID NO: 2317 - RNA, 21 nt, Artificial Sequence
  Synthetic construct
uuguauagaauacucguacac

SEQ ID NO: 2318 - RNA, 21 nt, Artificial Sequence
  Synthetic construct
uugcucuggaauuccagugaa

SEQ ID NO: 2319 - RNA, 21 nt, Artificial Sequence
  Synthetic construct
uagaauuugagaacaucuaga

SEQ ID NO: 2320 - RNA, 21 nt, Artificial Sequence
  Synthetic construct
uuauuugguacugcuggugaa

SEQ ID NO: 2321 - RNA, 21 nt, Artificial Sequence
  Synthetic construct
auuauuuacacgaucuuugag

SEQ ID NO: 2322 - RNA, 21 nt, Artificial Sequence
  Synthetic construct
uaauugcuuccuuugcagcga

SEQ ID NO: 2323 - RNA, 21 nt, Artificial Sequence
  Synthetic construct
auaaauuacauaaucugaggg

SEQ ID NO: 2324 - RNA, 21 nt, Artificial Sequence
  Synthetic construct
uuaaacacauucccaaugcau

SEQ ID NO: 2325 - RNA, 21 nt, Artificial Sequence
  Synthetic construct
uuucuuauucuucucuucagg

SEQ ID NO: 2326 - RNA, 21 nt, Artificial Sequence
  Synthetic construct
auuuccuagguucagaaccug

SEQ ID NO: 2327 - RNA, 21 nt, Artificial Sequence
  Synthetic construct
augagaaacagcuucuuucua

SEQ ID NO: 2328 - RNA, 21 nt, Artificial Sequence
  Synthetic construct
uucuccuaugaggauuuccua

SEQ ID NO: 2329 - RNA, 21 nt, Artificial Sequence
  Synthetic construct
uucuccuucuucuuauugguu

SEQ ID NO: 2330 - RNA, 21 nt, Artificial Sequence
  Synthetic construct
uaucccacuacaucugacuca

SEQ ID NO: 2331 - RNA, 21 nt, Artificial Sequence
  Synthetic construct
uuagcuucucuaagaucuccu

SEQ ID NO: 2332 - RNA, 21 nt, Artificial Sequence
  Synthetic construct
uggaaguuuggaguaaucgug

SEQ ID NO: 2333 - RNA, 21 nt, Artificial Sequence
  Synthetic construct
uauaguucccuuucugcuguu

SEQ ID NO: 2334 - RNA, 21 nt, Artificial Sequence
  Synthetic construct
uuacagauaacacauucugac

SEQ ID NO: 2335 - RNA, 21 nt, Artificial Sequence
  Synthetic construct
uuacucaugagggagauggug

SEQ ID NO: 2336 - RNA, 21 nt, Artificial Sequence
  Synthetic construct
ucaucuaguccaauacacuua

SEQ ID NO: 2337 - RNA, 21 nt, Artificial Sequence
  Synthetic construct
uugucacucuuuauaucucua

SEQ ID NO: 2338 - RNA, 21 nt, Artificial Sequence
  Synthetic construct
uucagucuuacucaugaggga

SEQ ID NO: 2339 - RNA, 21 nt, Artificial Sequence
  Synthetic construct
uaucugaggugacuaccucau

SEQ ID NO: 2340 - RNA, 21 nt, Artificial Sequence
  Synthetic construct
uagaacagcuuguggguucuu

SEQ ID NO: 2341 - RNA, 21 nt, Artificial Sequence
  Synthetic construct
uauuuaucccacuacaucuga

SEQ ID NO: 2342 - RNA, 21 nt, Artificial Sequence
  Synthetic construct
uaagaucuccucaucugucau

SEQ ID NO: 2343 - RNA, 21 nt, Artificial Sequence
  Synthetic construct
uaguccaauacacuuauuuua

SEQ ID NO: 2344 - RNA, 21 nt, Artificial Sequence
  Synthetic construct
uuacauacagacuguauggaa

SEQ ID NO: 2345 - RNA, 21 nt, Artificial Sequence
  Synthetic construct
ugagaacaucuagaacagcuu

SEQ ID NO: 2346 - RNA, 21 nt, Artificial Sequence
  Synthetic construct
auaaguucuguuuagauucuu

SEQ ID NO: 2347 - RNA, 21 nt, Artificial Sequence
  Synthetic construct
uacucgauuguaccaaaugug

SEQ ID NO: 2348 - RNA, 21 nt, Artificial Sequence
  Synthetic construct
uaacauaaagaauaaauacuu

SEQ ID NO: 2349 - RNA, 21 nt, Artificial Sequence
  Synthetic construct
uuguaccaaaugugaauccuu

SEQ ID NO: 2350 - RNA, 21 nt, Artificial Sequence
  Synthetic construct
ucuuauucuucucuucagggg

SEQ ID NO: 2351 - RNA, 21 nt, Artificial Sequence
  Synthetic construct
uucucugccuacagugaucug

SEQ ID NO: 2352 - RNA, 21 nt, Artificial Sequence
  Synthetic construct
uauaacacaaauuguuaguuu

SEQ ID NO: 2353 - RNA, 21 nt, Artificial Sequence
  Synthetic construct
uuaagugacuugccuagcguc

SEQ ID NO: 2354 - RNA, 21 nt, Artificial Sequence
  Synthetic construct
uuuagguucacucuuagcagu

SEQ ID NO: 2355 - RNA, 21 nt, Artificial Sequence
  Synthetic construct
uauuauuaugaacuucauuug

SEQ ID NO: 2356 - RNA, 21 nt, Artificial Sequence
  Synthetic construct
auagguacacaaaccaagcca

SEQ ID NO: 2357 - RNA, 21 nt, Artificial Sequence
  Synthetic construct
aagaauuucacuacacauggu

SEQ ID NO: 2358 - RNA, 21 nt, Artificial Sequence
  Synthetic construct
uacaaugacacacacacgaga

SEQ ID NO: 2359 - RNA, 21 nt, Artificial Sequence
  Synthetic construct
aaguauuccaugacuacccau

SEQ ID NO: 2360 - RNA, 21 nt, Artificial Sequence
  Synthetic construct
uaucucuauggaucaccuggu

SEQ ID NO: 2361 - RNA, 21 nt, Artificial Sequence
  Synthetic construct
uaaggaauucugucggacuga

SEQ ID NO: 2362 - RNA, 21 nt, Artificial Sequence
  Synthetic construct
auauaguuugcugaaacucua

SEQ ID NO: 2363 - RNA, 21 nt, Artificial Sequence
  Synthetic construct
aucuagaacagcuuguggguu

SEQ ID NO: 2364 - RNA, 21 nt, Artificial Sequence
  Synthetic construct
uacuuaauguccaacaaggau

SEQ ID NO: 2365 - RNA, 21 nt, Artificial Sequence
  Synthetic construct
uuccucuucaucuucuucuuc

SEQ ID NO: 2366 - RNA, 21 nt, Artificial Sequence
  Synthetic construct
aacaucuagaacagcuugugg

SEQ ID NO: 2367 - RNA, 21 nt, Artificial Sequence
  Synthetic construct
ucauauaaggaauucugucgg

SEQ ID NO: 2368 - RNA, 21 nt, Artificial Sequence
  Synthetic construct
uuagguccaaguuucaaacug

SEQ ID NO: 2369 - RNA, 21 nt, Artificial Sequence
  Synthetic construct
uuucuccuucuucuuauuggu

SEQ ID NO: 2370 - RNA, 21 nt, Artificial Sequence
  Synthetic construct
uuccuguacaaaguacuggaa

SEQ ID NO: 2371 - RNA, 21 nt, Artificial Sequence
  Synthetic construct
auuaguagcuacaggauucug

SEQ ID NO: 2372 - RNA, 21 nt, Artificial Sequence
  Synthetic construct
uaaugaauaugguauuugcgg

SEQ ID NO: 2373 - RNA, 21 nt, Artificial Sequence
  Synthetic construct
uugagaacaucuagaacagcu

SEQ ID NO: 2374 - RNA, 21 nt, Artificial Sequence
  Synthetic construct
aucuucuucuucuucuuccuc

SEQ ID NO: 2375 - RNA, 21 nt, Artificial Sequence
  Synthetic construct
uauucuacauuuaucugguuu

SEQ ID NO: 2376 - RNA, 21 nt, Artificial Sequence
  Synthetic construct
ugaaacuaagcagcauaucug

SEQ ID NO: 2377 - RNA, 21 nt, Artificial Sequence
  Synthetic construct
uucauaggagaaauauuccau

SEQ ID NO: 2378 - RNA, 21 nt, Artificial Sequence
  Synthetic construct
aagacauuuaugaauaugcuu

SEQ ID NO: 2379 - RNA, 21 nt, Artificial Sequence
  Synthetic construct
ucuagugcuguauaaacagua

SEQ ID NO: 2380 - RNA, 21 nt, Artificial Sequence
  Synthetic construct
uagccuucacugaccucccau

SEQ ID NO: 2381 - RNA, 21 nt, Artificial Sequence
  Synthetic construct
uauuuaacugcaacauaagag

SEQ ID NO: 2382 - RNA, 21 nt, Artificial Sequence
  Synthetic construct
uuucuauucauuugaaaggua

SEQ ID NO: 2383 - RNA, 21 nt, Artificial Sequence
  Synthetic construct
uagcuucucuaagaucuccuc

SEQ ID NO: 2384 - RNA, 21 nt, Artificial Sequence
  Synthetic construct
uuauuaugaacuucauuugcu

SEQ ID NO: 2385 - RNA, 21 nt, Artificial Sequence
  Synthetic construct
uuuacaaaugcugaauuucag

SEQ ID NO: 2386 - RNA, 21 nt, Artificial Sequence
  Synthetic construct
uuauaagaaguuucuauucau

SEQ ID NO: 2387 - RNA, 21 nt, Artificial Sequence
  Synthetic construct
ucaguauucuacauuuaucug

SEQ ID NO: 2388 - RNA, 21 nt, Artificial Sequence
  Synthetic construct
uuuauggucacuucaacauug

SEQ ID NO: 2389 - RNA, 21 nt, Artificial Sequence
  Synthetic construct
auuguuaauaugcugaacuga

SEQ ID NO: 2390 - RNA, 21 nt, Artificial Sequence
  Synthetic construct
uugcagucuuagcggcugcug

SEQ ID NO: 2391 - RNA, 21 nt, Artificial Sequence
  Synthetic construct
auacagcugacagucucucag

SEQ ID NO: 2392 - RNA, 21 nt, Artificial Sequence
  Synthetic construct
uaaauacuugaguuaaaucuu

SEQ ID NO: 2393 - RNA, 21 nt, Artificial Sequence
  Synthetic construct
uaguagcuacaggauucugug

SEQ ID NO: 2394 - RNA, 21 nt, Artificial Sequence
  Synthetic construct
cuugcuaacaacauuaacguu

SEQ ID NO: 2395 - RNA, 21 nt, Artificial Sequence
  Synthetic construct
auggucacuucaacauugcug

SEQ ID NO: 2396 - RNA, 21 nt, Artificial Sequence
  Synthetic construct
uucguuuacuuugcucaggag

SEQ ID NO: 2397 - RNA, 21 nt, Artificial Sequence
  Synthetic construct
ucacauaauuccaccacccua

SEQ ID NO: 2398 - RNA, 21 nt, Artificial Sequence
  Synthetic construct
auauacaguaauauccuguug

SEQ ID NO: 2399 - RNA, 21 nt, Artificial Sequence
  Synthetic construct
uaucaccuuucucuagaucuu

SEQ ID NO: 2400 - RNA, 21 nt, Artificial Sequence
  Synthetic construct
uaugaacuucauuugcuugag

SEQ ID NO: 2401 - RNA, 21 nt, Artificial Sequence
  Synthetic construct
uuagaaauauacauaacucuc

SEQ ID NO: 2402 - RNA, 21 nt, Artificial Sequence
  Synthetic construct
uauuauaacaauaucaaauaa

SEQ ID NO: 2403 - RNA, 21 nt, Artificial Sequence
  Synthetic construct
uaacuucuauugaaauuagug

SEQ ID NO: 2404 - RNA, 21 nt, Artificial Sequence
  Synthetic construct
uucuucuuccucuucaucuuc

SEQ ID NO: 2405 - RNA, 21 nt, Artificial Sequence
  Synthetic construct
uugucaacauuucucaaugcu

SEQ ID NO: 2406 - RNA, 21 nt, Artificial Sequence
  Synthetic construct
uucugcuguuuauuuauugua

SEQ ID NO: 2407 - RNA, 21 nt, Artificial Sequence
  Synthetic construct
uagauggucucccuugcucuu

SEQ ID NO: 2408 - RNA, 21 nt, Artificial Sequence
  Synthetic construct
auacucguacacacaggugug

SEQ ID NO: 2409 - RNA, 21 nt, Artificial Sequence
  Synthetic construct
uucuucuucuucuuccucuuc

SEQ ID NO: 2410 - RNA, 21 nt, Artificial Sequence
  Synthetic construct
auacuugaguuaaaucuucuu

SEQ ID NO: 2411 - RNA, 21 nt, Artificial Sequence
  Synthetic construct
uuguaacuagcaaauaucucu

SEQ ID NO: 2412 - RNA, 21 nt, Artificial Sequence
  Synthetic construct
uucacauaauuccaccacccu

SEQ ID NO: 2413 - RNA, 21 nt, Artificial Sequence
  Synthetic construct
uaaagcucauguauuucuggu

SEQ ID NO: 2414 - RNA, 21 nt, Artificial Sequence
  Synthetic construct
uaacuagcaaauaucucugcc

SEQ ID NO: 2415 - RNA, 21 nt, Artificial Sequence
  Synthetic construct
uauugauugggauguagccuu

SEQ ID NO: 2416 - RNA, 21 nt, Artificial Sequence
  Synthetic construct
auaaucucuacugugcuucuc

SEQ ID NO: 2417 - RNA, 21 nt, Artificial Sequence
  Synthetic construct
uaaucgugcccauugcucugg

SEQ ID NO: 2418 - RNA, 21 nt, Artificial Sequence
  Synthetic construct
uuaguagcuacaggauucugu

SEQ ID NO: 2419 - RNA, 21 nt, Artificial Sequence
  Synthetic construct
aaggagauuaacaaccugguu

SEQ ID NO: 2420 - RNA, 21 nt, Artificial Sequence
  Synthetic construct
uaaagaauaaauacuugaguu

SEQ ID NO: 2421 - RNA, 21 nt, Artificial Sequence
  Synthetic construct
uuuaacugcaacauaagagac

SEQ ID NO: 2422 - RNA, 21 nt, Artificial Sequence
  Synthetic construct
ucuagguauagggucugcuuu

SEQ ID NO: 2423 - RNA, 21 nt, Artificial Sequence
  Synthetic construct
augaacacaccauauuccgaa

SEQ ID NO: 2424 - RNA, 21 nt, Artificial Sequence
  Synthetic construct
uuggaguucuaauagugacau

SEQ ID NO: 2425 - RNA, 21 nt, Artificial Sequence
  Synthetic construct
auagugacaucucccuagcuu

SEQ ID NO: 2426 - RNA, 21 nt, Artificial Sequence
  Synthetic construct
ucacacaguacuugcucuggu

SEQ ID NO: 2427 - RNA, 21 nt, Artificial Sequence
  Synthetic construct
uuuagguaucauuaucuuugu

SEQ ID NO: 2428 - RNA, 21 nt, Artificial Sequence
  Synthetic construct
uauuucuguauugagaaugac

SEQ ID NO: 2429 - RNA, 21 nt, Artificial Sequence
  Synthetic construct
ucuaaugacaaugcaagugaa

SEQ ID NO: 2430 - RNA, 21 nt, Artificial Sequence
  Synthetic construct
uucacacaguacuugcucugg

SEQ ID NO: 2431 - RNA, 21 nt, Artificial Sequence
  Synthetic construct
uucuucuucagacacaggagg

SEQ ID NO: 2432 - RNA, 21 nt, Artificial Sequence
  Synthetic construct
ucugucggacugacauuucuu

SEQ ID NO: 2433 - RNA, 21 nt, Artificial Sequence
  Synthetic construct
uucuuauucuucucuucaggg

SEQ ID NO: 2434 - RNA, 21 nt, Artificial Sequence
  Synthetic construct
aaggcuuagagaaacaacuuu

SEQ ID NO: 2435 - RNA, 21 nt, Artificial Sequence
  Synthetic construct
uaauaugcugaacugaaagca

SEQ ID NO: 2436 - RNA, 21 nt, Artificial Sequence
  Synthetic construct
uuaauugcuuccuuugcagcg

SEQ ID NO: 2437 - RNA, 21 nt, Artificial Sequence
  Synthetic construct
uuguucagagcucagagacug

SEQ ID NO: 2438 - RNA, 21 nt, Artificial Sequence
  Synthetic construct
acaucuagaacagcuuguggg

SEQ ID NO: 2439 - RNA, 21 nt, Artificial Sequence
  Synthetic construct
aucuguugaacauguugccag

SEQ ID NO: 2440 - RNA, 21 nt, Artificial Sequence
  Synthetic construct
aaauaaauaaucucuacugug

SEQ ID NO: 2441 - RNA, 21 nt, Artificial Sequence
  Synthetic construct
uuacaacuaauuucacagcuc

SEQ ID NO: 2442 - RNA, 21 nt, Artificial Sequence
  Synthetic construct
auagaauacucguacacacag

SEQ ID NO: 2443 - RNA, 21 nt, Artificial Sequence
  Synthetic construct
uuacacgaucuuugagcugag

SEQ ID NO: 2444 - RNA, 21 nt, Artificial Sequence
  Synthetic construct
uauggucacuucaacauugcu

SEQ ID NO: 2445 - RNA, 21 nt, Artificial Sequence
  Synthetic construct
uauucuagcaagugugacagu

SEQ ID NO: 2446 - RNA, 21 nt, Artificial Sequence
  Synthetic construct
uaauagucuccuaagaaagcg

SEQ ID NO: 2447 - RNA, 21 nt, Artificial Sequence
  Synthetic construct
aacuaagcaugaacacaccau

SEQ ID NO: 2448 - RNA, 21 nt, Artificial Sequence
  Synthetic construct
uuucauaagcacaagagagga

SEQ ID NO: 2449 - RNA, 21 nt, Artificial Sequence
  Synthetic construct
uacuuuagguccaaguuucaa

SEQ ID NO: 2450 - RNA, 21 nt, Artificial Sequence
  Synthetic construct
uauuaucaaaucuugguacaa

SEQ ID NO: 2451 - RNA, 21 nt, Artificial Sequence
  Synthetic construct
uuucgcuucacgguggaagug

SEQ ID NO: 2452 - RNA, 21 nt, Artificial Sequence
  Synthetic construct
uuauacagacaacaggaagca

SEQ ID NO: 2453 - RNA, 21 nt, Artificial Sequence
  Synthetic construct
ucggacugacauuucuuggga

SEQ ID NO: 2454 - RNA, 21 nt, Artificial Sequence
  Synthetic construct
ucuucuucuucagacacagga

SEQ ID NO: 2455 - RNA, 21 nt, Artificial Sequence
  Synthetic construct
uauauggugaaauaguaguca

SEQ ID NO: 2456 - RNA, 21 nt, Artificial Sequence
  Synthetic construct
uuucucaaugcuaauagcaug

SEQ ID NO: 2457 - RNA, 21 nt, Artificial Sequence
  Synthetic construct
uuuguccauaugcauuucuuu

SEQ ID NO: 2458 - RNA, 21 nt, Artificial Sequence
  Synthetic construct
uugcuaacaacauuaacguuc

SEQ ID NO: 2459 - RNA, 21 nt, Artificial Sequence
  Synthetic construct
ucuauaguucccuuucugcug

SEQ ID NO: 2460 - RNA, 21 nt, Artificial Sequence
  Synthetic construct
uagguucagaaccugaacuca

SEQ ID NO: 2461 - RNA, 21 nt, Artificial Sequence
  Synthetic construct
ucaucuuacauaguucuuuua

SEQ ID NO: 2462 - RNA, 21 nt, Artificial Sequence
  Synthetic construct
uuuauagacaaauaucucaaa

SEQ ID NO: 2463 - RNA, 21 nt, Artificial Sequence
  Synthetic construct
aaacuaagcagcauaucugag

SEQ ID NO: 2464 - RNA, 21 nt, Artificial Sequence
  Synthetic construct
acucuuagcagucucagccau

SEQ ID NO: 2465 - RNA, 21 nt, Artificial Sequence
  Synthetic construct
aaagcuugcaggcacucucug

SEQ ID NO: 2466 - RNA, 21 nt, Artificial Sequence
  Synthetic construct
uuauguuggaaguuuggagua

SEQ ID NO: 2467 - RNA, 21 nt, Artificial Sequence
  Synthetic construct
auacuuauuagaaauauacau

SEQ ID NO: 2468 - RNA, 21 nt, Artificial Sequence
  Synthetic construct
ucuuuggugaguuagaaggaa

SEQ ID NO: 2469 - RNA, 21 nt, Artificial Sequence
  Synthetic construct
uagauaauagucuccuaagaa

SEQ ID NO: 2470 - RNA, 21 nt, Artificial Sequence
  Synthetic construct
aucaccuuucucuagaucuuu

SEQ ID NO: 2471 - RNA, 21 nt, Artificial Sequence
  Synthetic construct
ugaaggaagagagaucucugg

SEQ ID NO: 2472 - RNA, 21 nt, Artificial Sequence
  Synthetic construct
ucauccauacaggucucugug

SEQ ID NO: 2473 - RNA, 21 nt, Artificial Sequence
  Synthetic construct
uaccaaaugugaauccuucag

SEQ ID NO: 2474 - RNA, 21 nt, Artificial Sequence
  Synthetic construct
auucugugaagaucuuaucau

SEQ ID NO: 2475 - RNA, 21 nt, Artificial Sequence
  Synthetic construct
uucuuaauugcuuccuuugca

SEQ ID NO: 2476 - RNA, 21 nt, Artificial Sequence
  Synthetic construct
uaaggagauuaacaaccuggu

SEQ ID NO: 2477 - RNA, 21 nt, Artificial Sequence
  Synthetic construct
ugaauguacauaaguucuguu

SEQ ID NO: 2478 - RNA, 21 nt, Artificial Sequence
  Synthetic construct
uuuacuauaucaccuuucucu

SEQ ID NO: 2479 - RNA, 21 nt, Artificial Sequence
  Synthetic construct
auaauuauuuacacgaucuuu

SEQ ID NO: 2480 - RNA, 21 nt, Artificial Sequence
  Synthetic construct
ucaucugucaucuuggauuuu

SEQ ID NO: 2481 - RNA, 21 nt, Artificial Sequence
  Synthetic construct
aucaucuaguccaauacacuu

SEQ ID NO: 2482 - RNA, 21 nt, Artificial Sequence
  Synthetic construct
auagucuccuaagaaagcgug

SEQ ID NO: 2483 - RNA, 21 nt, Artificial Sequence
  Synthetic construct
aucuccugaacauaaacacgu

SEQ ID NO: 2484 - RNA, 21 nt, Artificial Sequence
  Synthetic construct
uaagggaugcuaacuaaugaa

SEQ ID NO: 2485 - RNA, 21 nt, Artificial Sequence
  Synthetic construct
acaacaggaagcaauuucgug

SEQ ID NO: 2486 - RNA, 21 nt, Artificial Sequence
  Synthetic construct
ugaaauaguagucaaauuuug

SEQ ID NO: 2487 - RNA, 21 nt, Artificial Sequence
  Synthetic construct
uauguaacugaucucuuuccc

SEQ ID NO: 2488 - RNA, 21 nt, Artificial Sequence
  Synthetic construct
auuaacaauauuaggguucuu

SEQ ID NO: 2489 - RNA, 21 nt, Artificial Sequence
  Synthetic construct
uuuacuuugcucaggagugau

SEQ ID NO: 2490 - RNA, 21 nt, Artificial Sequence
  Synthetic construct
uuggucacuuaaaggagugug

SEQ ID NO: 2491 - RNA, 21 nt, Artificial Sequence
  Synthetic construct
uauacaguaauauccuguugg

SEQ ID NO: 2492 - RNA, 21 nt, Artificial Sequence
  Synthetic construct
uacaguaauauccuguuggac

SEQ ID NO: 2493 - RNA, 21 nt, Artificial Sequence
  Synthetic construct
aagcacaccacacacaagcac

SEQ ID NO: 2494 - RNA, 21 nt, Artificial Sequence
  Synthetic construct
auuaugaacuucauuugcuug

SEQ ID NO: 2495 - RNA, 21 nt, Artificial Sequence
  Synthetic construct
uaauuaauuccuucuuggguu

SEQ ID NO: 2496 - RNA, 21 nt, Artificial Sequence
  Synthetic construct
uaaauaauuaacaauauuagg

SEQ ID NO: 2497 - RNA, 21 nt, Artificial Sequence
  Synthetic construct
uucuacauuuaucugguuuug

SEQ ID NO: 2498 - RNA, 21 nt, Artificial Sequence
  Synthetic construct
uugcaaugucuagugcuguau

SEQ ID NO: 2499 - RNA, 21 nt, Artificial Sequence
  Synthetic construct
ugugcaucuuugagaaaccuu

SEQ ID NO: 2500 - RNA, 21 nt, Artificial Sequence
  Synthetic construct
uacagcugacagucucucagg

SEQ ID NO: 2501 - RNA, 21 nt, Artificial Sequence
  Synthetic construct
uguaacugaucucuuuccccu

SEQ ID NO: 2502 - RNA, 21 nt, Artificial Sequence
  Synthetic construct
ucaaguacaguuauauucuag

SEQ ID NO: 2503 - RNA, 21 nt, Artificial Sequence
  Synthetic construct
uggacaucuaaugacaaugca

SEQ ID NO: 2504 - RNA, 21 nt, Artificial Sequence
  Synthetic construct
acucauucucuacuaucgcug

SEQ ID NO: 2505 - RNA, 21 nt, Artificial Sequence
  Synthetic construct
uugagaauuaaacucuagaaa

SEQ ID NO: 2506 - RNA, 21 nt, Artificial Sequence
  Synthetic construct
ugaauagggcuuccuaaccag

SEQ ID NO: 2507 - RNA, 21 nt, Artificial Sequence
  Synthetic construct
auucuagcaagugugacagug

SEQ ID NO: 2508 - RNA, 21 nt, Artificial Sequence
  Synthetic construct
uaaugauuucaaagucagcuu

SEQ ID NO: 2509 - RNA, 21 nt, Artificial Sequence
  Synthetic construct
uagcaauuuaguaauaaagcu

SEQ ID NO: 2510 - RNA, 21 nt, Artificial Sequence
  Synthetic construct
ugacagucucucaggauucug

SEQ ID NO: 2511 - RNA, 21 nt, Artificial Sequence
  Synthetic construct
aucgcuguugauuuccucuug

SEQ ID NO: 2512 - RNA, 21 nt, Artificial Sequence
  Synthetic construct
uguuccuguacaaaguacugg

SEQ ID NO: 2513 - RNA, 21 nt, Artificial Sequence
  Synthetic construct
uacaauucugauaaacaauga

SEQ ID NO: 2514 - RNA, 21 nt, Artificial Sequence
  Synthetic construct
auaauuaauuccuucuugggu

SEQ ID NO: 2515 - RNA, 21 nt, Artificial Sequence
  Synthetic construct
auuaauaauuaauuccuucuu

SEQ ID NO: 2516 - RNA, 21 nt, Artificial Sequence
  Synthetic construct
uucuucuucuguuccaauuuu

SEQ ID NO: 2517 - RNA, 21 nt, Artificial Sequence
  Synthetic construct
aagcagagggcagacaaccug

SEQ ID NO: 2518 - RNA, 21 nt, Artificial Sequence
  Synthetic construct
uucucuucauuauccagaccg

SEQ ID NO: 2519 - RNA, 21 nt, Artificial Sequence
  Synthetic construct
uucuuuggugaguuagaagga

SEQ ID NO: 2520 - RNA, 21 nt, Artificial Sequence
  Synthetic construct
uacaucugacucauucucuac

SEQ ID NO: 2521 - RNA, 21 nt, Artificial Sequence
  Synthetic construct
aaacacaacacuaugaagagg

SEQ ID NO: 2522 - RNA, 21 nt, Artificial Sequence
  Synthetic construct
ucuuaauugcuuccuuugcag

SEQ ID NO: 2523 - RNA, 21 nt, Artificial Sequence
  Synthetic construct
auuugagaacaucuagaacag

SEQ ID NO: 2524 - RNA, 21 nt, Artificial Sequence
  Synthetic construct
ucgaacuccugaccucaggug

SEQ ID NO: 2525 - RNA, 21 nt, Artificial Sequence
  Synthetic construct
uaugcucaaagucugaaggaa

SEQ ID NO: 2526 - RNA, 21 nt, Artificial Sequence
  Synthetic construct
uaguucaucacccaccaagua

SEQ ID NO: 2527 - RNA, 21 nt, Artificial Sequence
  Synthetic construct
auuuauagacaaauaucucaa

SEQ ID NO: 2528 - RNA, 21 nt, Artificial Sequence
  Synthetic construct
uagaaauauacauaacucucc

SEQ ID NO: 2529 - RNA, 21 nt, Artificial Sequence
  Synthetic construct
uagauguaaggaucagguggu

SEQ ID NO: 2530 - RNA, 21 nt, Artificial Sequence
  Synthetic construct
aauuuagguaucauuaucuuu

SEQ ID NO: 2531 - RNA, 21 nt, Artificial Sequence
  Synthetic construct
auauauuauuaucaaaucuug

SEQ ID NO: 2532 - RNA, 21 nt, Artificial Sequence
  Synthetic construct
ucugcagacagcugcuaucug

SEQ ID NO: 2533 - RNA, 21 nt, Artificial Sequence
  Synthetic construct
uaucuuuguuuacuuaauguc

SEQ ID NO: 2534 - RNA, 21 nt, Artificial Sequence
  Synthetic construct
uauuccgaaacagaaauaggu

SEQ ID NO: 2535 - RNA, 21 nt, Artificial Sequence
  Synthetic construct
uaucauuaucuuuguuuacuu

SEQ ID NO: 2536 - RNA, 21 nt, Artificial Sequence
  Synthetic construct
ugaacauaaacacguacacua

SEQ ID NO: 2537 - RNA, 21 nt, Artificial Sequence
  Synthetic construct
uugauuuccucuuggguacua

SEQ ID NO: 2538 - RNA, 21 nt, Artificial Sequence
  Synthetic construct
uaaacaguaccugaugccccu

SEQ ID NO: 2539 - RNA, 21 nt, Artificial Sequence
  Synthetic construct
uagaaggaaguuauccuuugg

SEQ ID NO: 2540 - RNA, 21 nt, Artificial Sequence
  Synthetic construct
aauaauuaacaauauuagggu

SEQ ID NO: 2541 - RNA, 21 nt, Artificial Sequence
  Synthetic construct
ucuuuguuuacuuaaugucca

SEQ ID NO: 2542 - RNA, 21 nt, Artificial Sequence
  Synthetic construct
ugaacugaaagcauaagagag

SEQ ID NO: 2543 - RNA, 21 nt, Artificial Sequence
  Synthetic construct
uagauauauggugaaauagua

SEQ ID NO: 2544 - RNA, 21 nt, Artificial Sequence
  Synthetic construct
uagacaucacuacccugugau

SEQ ID NO: 2545 - RNA, 21 nt, Artificial Sequence
  Synthetic construct
auaaauaaucucuacugugcu

SEQ ID NO: 2546 - RNA, 21 nt, Artificial Sequence
  Synthetic construct
ugcuaucuguccuucauccau

SEQ ID NO: 2547 - RNA, 21 nt, Artificial Sequence
  Synthetic construct
uuagacauuguuuaauauuaa

SEQ ID NO: 2548 - RNA, 21 nt, Artificial Sequence
  Synthetic construct
uuaugaacuucauuugcuuga

SEQ ID NO: 2549 - RNA, 21 nt, Artificial Sequence
  Synthetic construct
uuucauuaauaauuaauuccu

SEQ ID NO: 2550 - RNA, 21 nt, Artificial Sequence
  Synthetic construct
uaacacaacugauuucaauua

SEQ ID NO: 2551 - RNA, 21 nt, Artificial Sequence
  Synthetic construct
auuagaaauauacauaacucu

SEQ ID NO: 2552 - RNA, 21 nt, Artificial Sequence
  Synthetic construct
uucaucuucuucuucagacac

SEQ ID NO: 2553 - RNA, 21 nt, Artificial Sequence
  Synthetic construct
uuaauguccaacaaggauuuc

SEQ ID NO: 2554 - RNA, 21 nt, Artificial Sequence
  Synthetic construct
ucuugguacaaagugguagua

SEQ ID NO: 2555 - RNA, 21 nt, Artificial Sequence
  Synthetic construct
uacagugaucugaagggucac

SEQ ID NO: 2556 - RNA, 21 nt, Artificial Sequence
  Synthetic construct
augacaacgcacuggauccuu

SEQ ID NO: 2557 - RNA, 21 nt, Artificial Sequence
  Synthetic construct
uuuaacuuauagauaauaguc

SEQ ID NO: 2558 - RNA, 21 nt, Artificial Sequence
  Synthetic construct
uugguacugcuggugaagcaa

SEQ ID NO: 2559 - RNA, 21 nt, Artificial Sequence
  Synthetic construct
uguuuauuuauuguaaagcaa

SEQ ID NO: 2560 - RNA, 21 nt, Artificial Sequence
  Synthetic construct
uugcaagucauaacuucuauu

SEQ ID NO: 2561 - RNA, 21 nt, Artificial Sequence
  Synthetic construct
aacacguacacuauauaguuu

SEQ ID NO: 2562 - RNA, 21 nt, Artificial Sequence
  Synthetic construct
uucauaagcacaagagaggau

SEQ ID NO: 2563 - RNA, 21 nt, Artificial Sequence
  Synthetic construct
aacaacuguaaaugaauugga

SEQ ID NO: 2564 - RNA, 21 nt, Artificial Sequence
  Synthetic construct
uucccauuuauuuccuuccca

SEQ ID NO: 2565 - RNA, 21 nt, Artificial Sequence
  Synthetic construct
uuggugaguuagaaggaaguu

SEQ ID NO: 2566 - RNA, 21 nt, Artificial Sequence
  Synthetic construct
uuuauuguaaagcaauauuau

SEQ ID NO: 2567 - RNA, 21 nt, Artificial Sequence
  Synthetic construct
uaaguauuucuguauugagaa

SEQ ID NO: 2568 - RNA, 21 nt, Artificial Sequence
  Synthetic construct
ucugguuguugacuguuucuu

SEQ ID NO: 2569 - RNA, 21 nt, Artificial Sequence
  Synthetic construct
aauugcaagucauaacuucua

SEQ ID NO: 2570 - RNA, 21 nt, Artificial Sequence
  Synthetic construct
agacuuuacauacagacugua

SEQ ID NO: 2571 - RNA, 21 nt, Artificial Sequence
  Synthetic construct
uaacacaaauuguuaguuuuu

SEQ ID NO: 2572 - RNA, 21 nt, Artificial Sequence
  Synthetic construct
ugguuaaacucaaacauuggg

SEQ ID NO: 2573 - RNA, 21 nt, Artificial Sequence
  Synthetic construct
uuucucucugcaacuuguaag

SEQ ID NO: 2574 - RNA, 21 nt, Artificial Sequence
  Synthetic construct
uaauaauuaauuccuucuugg

SEQ ID NO: 2575 - RNA, 21 nt, Artificial Sequence
  Synthetic construct
uacucguacacacaggugugc

SEQ ID NO: 2576 - RNA, 21 nt, Artificial Sequence
  Synthetic construct
ugauauacaguaauauccugu

SEQ ID NO: 2577 - RNA, 21 nt, Artificial Sequence
  Synthetic construct
uccucgccuauccacauccau

SEQ ID NO: 2578 - RNA, 21 nt, Artificial Sequence
  Synthetic construct
auuugcaauacuuuaggucca

SEQ ID NO: 2579 - RNA, 21 nt, Artificial Sequence
  Synthetic construct
auaaucagaggagucaggcug

SEQ ID NO: 2580 - RNA, 21 nt, Artificial Sequence
  Synthetic construct
uguaucuauuuccuccuggua

SEQ ID NO: 2581 - RNA, 21 nt, Artificial Sequence
  Synthetic construct
uauauggaugguuagauggau

SEQ ID NO: 2582 - RNA, 21 nt, Artificial Sequence
  Synthetic construct
uacuauucauccucaguggag

SEQ ID NO: 2583 - RNA, 21 nt, Artificial Sequence
  Synthetic construct
auaaggaauucugucggacug

SEQ ID NO: 2584 - RNA, 21 nt, Artificial Sequence
  Synthetic construct
agaacuauaacugaaugccaa

SEQ ID NO: 2585 - RNA, 21 nt, Artificial Sequence
  Synthetic construct
acaagcacacacauugaacuu

SEQ ID NO: 2586 - RNA, 21 nt, Artificial Sequence
  Synthetic construct
ucaccuagcaggaugucacag

SEQ ID NO: 2587 - RNA, 21 nt, Artificial Sequence
  Synthetic construct
uuugcagcgauaaucagagga

SEQ ID NO: 2588 - RNA, 21 nt, Artificial Sequence
  Synthetic construct
uaacagaacuauaacugaaug

SEQ ID NO: 2589 - RNA, 21 nt, Artificial Sequence
  Synthetic construct
uugcucaggagugaucugggc

SEQ ID NO: 2590 - RNA, 21 nt, Artificial Sequence
  Synthetic construct
uugggauguagccuucacuga

SEQ ID NO: 2591 - RNA, 21 nt, Artificial Sequence
  Synthetic construct
auauugauugggauguagccu

SEQ ID NO: 2592 - RNA, 21 nt, Artificial Sequence
  Synthetic construct
uuauuuagauauacaguuuuu

SEQ ID NO: 2593 - RNA, 21 nt, Artificial Sequence
  Synthetic construct
uguugcaaugucuagugcugu

SEQ ID NO: 2594 - RNA, 21 nt, Artificial Sequence
  Synthetic construct
aacagcuucuuucuaauacuu

SEQ ID NO: 2595 - RNA, 21 nt, Artificial Sequence
  Synthetic construct
uagguaucauuaucuuuguuu

SEQ ID NO: 2596 - RNA, 21 nt, Artificial Sequence
  Synthetic construct
auuguaacuagcaaauaucuc

SEQ ID NO: 2597 - RNA, 21 nt, Artificial Sequence
  Synthetic construct
uuagaaggaaguuauccuuug

SEQ ID NO: 2598 - RNA, 21 nt, Artificial Sequence
  Synthetic construct
auuucuugggauaugauugua

SEQ ID NO: 2599 - RNA, 21 nt, Artificial Sequence
  Synthetic construct
uugaagguucaucugcuuuau

SEQ ID NO: 2600 - RNA, 21 nt, Artificial Sequence
  Synthetic construct
uuauccuuugguuagaugguc

SEQ ID NO: 2601 - RNA, 21 nt, Artificial Sequence
  Synthetic construct
ucuuuauuugguacugcuggu

SEQ ID NO: 2602 - RNA, 21 nt, Artificial Sequence
  Synthetic construct
ucaucaauaaugaauauggua

SEQ ID NO: 2603 - RNA, 21 nt, Artificial Sequence
  Synthetic construct
uuucagucuuacucaugaggg

SEQ ID NO: 2604 - RNA, 21 nt, Artificial Sequence
  Synthetic construct
uuagaagcuguucucauuuga

SEQ ID NO: 2605 - RNA, 21 nt, Artificial Sequence
  Synthetic construct
ucuucuucuucuucuuccucu

SEQ ID NO: 2606 - RNA, 21 nt, Artificial Sequence
  Synthetic construct
uuaacagaacuauaacugaau

SEQ ID NO: 2607 - RNA, 21 nt, Artificial Sequence
  Synthetic construct
uaauagcauguaauuacuuuu

SEQ ID NO: 2608 - RNA, 21 nt, Artificial Sequence
  Synthetic construct
auagacaaauaucucaaacua

SEQ ID NO: 2609 - RNA, 21 nt, Artificial Sequence
  Synthetic construct
acucucugcagacagcugcua

SEQ ID NO: 2610 - RNA, 21 nt, Artificial Sequence
  Synthetic construct
uuauauucauuuggucacuua

SEQ ID NO: 2611 - RNA, 21 nt, Artificial Sequence
  Synthetic construct
ucagucaauuuaacagagcca

SEQ ID NO: 2612 - RNA, 21 nt, Artificial Sequence
  Synthetic construct
uuacauaaucugagggaguag

SEQ ID NO: 2613 - RNA, 21 nt, Artificial Sequence
  Synthetic construct
uuuagaagcuguucucauuug

SEQ ID NO: 2614 - RNA, 21 nt, Artificial Sequence
  Synthetic construct
acuucuauugaaauuaguggg

SEQ ID NO: 2615 - RNA, 21 nt, Artificial Sequence
  Synthetic construct
uuaacugcaacauaagagacu

SEQ ID NO: 2616 - RNA, 21 nt, Artificial Sequence
  Synthetic construct
uuuguaucauaaguaaaugau

SEQ ID NO: 2617 - RNA, 21 nt, Artificial Sequence
  Synthetic construct
ucuucuucagacacaggaggg

SEQ ID NO: 2618 - RNA, 21 nt, Artificial Sequence
  Synthetic construct
uucacugaccucccauuucuu

SEQ ID NO: 2619 - RNA, 21 nt, Artificial Sequence
  Synthetic construct
uccucuuggguacuaaaucug

SEQ ID NO: 2620 - RNA, 21 nt, Artificial Sequence
  Synthetic construct
aucuccucaucugucaucuug

SEQ ID NO: 2621 - RNA, 21 nt, Artificial Sequence
  Synthetic construct
aauaauuaauuccuucuuggg

SEQ ID NO: 2622 - RNA, 21 nt, Artificial Sequence
  Synthetic construct
auugucacucuuuauaucucu

SEQ ID NO: 2623 - RNA, 21 nt, Artificial Sequence
  Synthetic construct
ugucggacugacauuucuugg

SEQ ID NO: 2624 - RNA, 21 nt, Artificial Sequence
  Synthetic construct
ugaauuugcaaggcaaccuau

SEQ ID NO: 2625 - RNA, 21 nt, Artificial Sequence
  Synthetic construct
uuuacaugaauacaaauuuau

SEQ ID NO: 2626 - RNA, 21 nt, Artificial Sequence
  Synthetic construct
uauuagggcauggacuuccac

SEQ ID NO: 2627 - RNA, 21 nt, Artificial Sequence
  Synthetic construct
uuucccggcacuaugagugaa

SEQ ID NO: 2628 - RNA, 21 nt, Artificial Sequence
  Synthetic construct
uacauaacucuccaauacagg

SEQ ID NO: 2629 - RNA, 21 nt, Artificial Sequence
  Synthetic construct
acaaauaucucaaacuaucaa

SEQ ID NO: 2630 - RNA, 21 nt, Artificial Sequence
  Synthetic construct
uagguacacaaaccaagccac

SEQ ID NO: 2631 - RNA, 21 nt, Artificial Sequence
  Synthetic construct
uucugucggacugacauuucu

SEQ ID NO: 2632 - RNA, 21 nt, Artificial Sequence
  Synthetic construct
uucaacauugcugcccuguuu

SEQ ID NO: 2633 - RNA, 21 nt, Artificial Sequence
  Synthetic construct
ugaagagggagugugcaucuu

SEQ ID NO: 2634 - RNA, 21 nt, Artificial Sequence
  Synthetic construct
ugaaacucuaaagaaagugcu

SEQ ID NO: 2635 - RNA, 21 nt, Artificial Sequence
  Synthetic construct
ugucacucuuuauaucucuau

SEQ ID NO: 2636 - RNA, 21 nt, Artificial Sequence
  Synthetic construct
uucauuuggucacuuaaagga

SEQ ID NO: 2637 - RNA, 21 nt, Artificial Sequence
  Synthetic construct
aagcucauauuagacuccggg

SEQ ID NO: 2638 - RNA, 21 nt, Artificial Sequence
  Synthetic construct
auacauaacucuccaauacag

SEQ ID NO: 2639 - RNA, 21 nt, Artificial Sequence
  Synthetic construct
ugucuagugcuguauaaacag

SEQ ID NO: 2640 - RNA, 21 nt, Artificial Sequence
  Synthetic construct
uagugacaucucccuagcuuu

SEQ ID NO: 2641 - RNA, 21 nt, Artificial Sequence
  Synthetic construct
uucuauugaaauuagugggac

SEQ ID NO: 2642 - RNA, 21 nt, Artificial Sequence
  Synthetic construct
uuauuuauuguaaagcaauau

SEQ ID NO: 2643 - RNA, 21 nt, Artificial Sequence
  Synthetic construct
auauggugaaauaguagucaa

SEQ ID NO: 2644 - RNA, 21 nt, Artificial Sequence
  Synthetic construct
ugaagcaauggauucaaccac

SEQ ID NO: 2645 - RNA, 21 nt, Artificial Sequence
  Synthetic construct
uuguccauaugcauuucuuuu

SEQ ID NO: 2646 - RNA, 21 nt, Artificial Sequence
  Synthetic construct
uuccgaaacagaaauagguga

SEQ ID NO: 2647 - RNA, 21 nt, Artificial Sequence
  Synthetic construct
auuagaaauaaacccauugag

SEQ ID NO: 2648 - RNA, 21 nt, Artificial Sequence
  Synthetic construct
uaauuccuucuuggguugcug

SEQ ID NO: 2649 - RNA, 21 nt, Artificial Sequence
  Synthetic construct
ugggauuaugacaacgcacug

SEQ ID NO: 2650 - RNA, 21 nt, Artificial Sequence
  Synthetic construct
uucauuauccagaccgucaga

SEQ ID NO: 2651 - RNA, 21 nt, Artificial Sequence
  Synthetic construct
ucucuucauuauccagaccgu

SEQ ID NO: 2652 - RNA, 21 nt, Artificial Sequence
  Synthetic construct
uucuuuggaaucauagaauuu

SEQ ID NO: 2653 - RNA, 21 nt, Artificial Sequence
  Synthetic construct
auauucuagcaagugugacag

SEQ ID NO: 2654 - RNA, 21 nt, Artificial Sequence
  Synthetic construct
uacugcaaauuaagaagccuu

SEQ ID NO: 2655 - RNA, 21 nt, Artificial Sequence
  Synthetic construct
aaauaaauuacauaaucugag

SEQ ID NO: 2656 - RNA, 21 nt, Artificial Sequence
  Synthetic construct
aaaguauaacauaguaugcuu

SEQ ID NO: 2657 - RNA, 21 nt, Artificial Sequence
  Synthetic construct
ugacucauucucuacuaucgc

SEQ ID NO: 2658 - RNA, 21 nt, Artificial Sequence
  Synthetic construct
aguacaguuauauucuagcaa

SEQ ID NO: 2659 - RNA, 21 nt, Artificial Sequence
  Synthetic construct
aacauuaacguucuuuccuuu

SEQ ID NO: 2660 - RNA, 21 nt, Artificial Sequence
  Synthetic construct
uuaucaucaauaaugaauaug

SEQ ID NO: 2661 - RNA, 21 nt, Artificial Sequence
  Synthetic construct
uuuauuuccuucccaguccac

SEQ ID NO: 2662 - RNA, 21 nt, Artificial Sequence
  Synthetic construct
uagcgucacauagcaauuuag

SEQ ID NO: 2663 - RNA, 21 nt, Artificial Sequence
  Synthetic construct
uacaggucucugugaccacau

SEQ ID NO: 2664 - RNA, 21 nt, Artificial Sequence
  Synthetic construct
uuucccacugcccuauuccua

SEQ ID NO: 2665 - RNA, 21 nt, Artificial Sequence
  Synthetic construct
uauguauccaugugcacuuuu

SEQ ID NO: 2666 - RNA, 21 nt, Artificial Sequence
  Synthetic construct
ucagucuuacucaugagggag

SEQ ID NO: 2667 - RNA, 21 nt, Artificial Sequence
  Synthetic construct
auaggaaauacaccagugggg

SEQ ID NO: 2668 - RNA, 21 nt, Artificial Sequence
  Synthetic construct
aaacaaccuauaaauaggcag

SEQ ID NO: 2669 - RNA, 21 nt, Artificial Sequence
  Synthetic construct
aucauuaucuuuguuuacuua

SEQ ID NO: 2670 - RNA, 21 nt, Artificial Sequence
  Synthetic construct
uauagaauacucguacacaca

SEQ ID NO: 2671 - RNA, 21 nt, Artificial Sequence
  Synthetic construct
aauagugacaucucccuagcu

SEQ ID NO: 2672 - RNA, 21 nt, Artificial Sequence
  Synthetic construct
aucucuauggaucaccugguu

SEQ ID NO: 2673 - RNA, 21 nt, Artificial Sequence
  Synthetic construct
uuaacaauauuaggguucuua

SEQ ID NO: 2674 - RNA, 21 nt, Artificial Sequence
  Synthetic construct
ucucuaagaucuccucaucug

SEQ ID NO: 2675 - RNA, 21 nt, Artificial Sequence
  Synthetic construct
uccucaucugucaucuuggau

SEQ ID NO: 2676 - RNA, 21 nt, Artificial Sequence
  Synthetic construct
uucauccauacaggucucugu

SEQ ID NO: 2677 - RNA, 21 nt, Artificial Sequence
  Synthetic construct
ugaauguuuacuauaucaccu

SEQ ID NO: 2678 - RNA, 21 nt, Artificial Sequence
  Synthetic construct
acagauaacacauucugacaa

SEQ ID NO: 2679 - RNA, 21 nt, Artificial Sequence
  Synthetic construct
uuuacacgaucuuugagcuga

SEQ ID NO: 2680 - RNA, 21 nt, Artificial Sequence
  Synthetic construct
aauacucguacacacaggugu

SEQ ID NO: 2681 - RNA, 21 nt, Artificial Sequence
  Synthetic construct
aaaucuugguacaaaguggua

SEQ ID NO: 2682 - RNA, 21 nt, Artificial Sequence
  Synthetic construct
auaucugaggugacuaccuca

SEQ ID NO: 2683 - RNA, 21 nt, Artificial Sequence
  Synthetic construct
ucucucauuagagcagugugg

SEQ ID NO: 2684 - RNA, 21 nt, Artificial Sequence
  Synthetic construct
uuggaaguuuggaguaaucgu

SEQ ID NO: 2685 - RNA, 21 nt, Artificial Sequence
  Synthetic construct
uugguuagauggucucccuug

SEQ ID NO: 2686 - RNA, 21 nt, Artificial Sequence
  Synthetic construct
uuugagcugagaaauaucauu

SEQ ID NO: 2687 - RNA, 21 nt, Artificial Sequence
  Synthetic construct
uugauugggauguagccuuca

SEQ ID NO: 2688 - RNA, 21 nt, Artificial Sequence
  Synthetic construct
ugaccucaggugauccgccug

SEQ ID NO: 2689 - RNA, 21 nt, Artificial Sequence
  Synthetic construct
aauauuuacaaugacacacac

SEQ ID NO: 2690 - RNA, 21 nt, Artificial Sequence
  Synthetic construct
uggauucaaccacagaacgag

SEQ ID NO: 2691 - RNA, 21 nt, Artificial Sequence
  Synthetic construct
uuucuguauugagaaugacca

SEQ ID NO: 2692 - RNA, 21 nt, Artificial Sequence
  Synthetic construct
uuguuaauaugcugaacugaa

SEQ ID NO: 2693 - RNA, 21 nt, Artificial Sequence
  Synthetic construct
acaacugauuucaauuaucug

SEQ ID NO: 2694 - RNA, 21 nt, Artificial Sequence
  Synthetic construct
ugcuuaacugaauauuaacug

SEQ ID NO: 2695 - RNA, 21 nt, Artificial Sequence
  Synthetic construct
auugcaagucauaacuucuau

SEQ ID NO: 2696 - RNA, 21 nt, Artificial Sequence
  Synthetic construct
aauguuuacuauaucaccuuu

SEQ ID NO: 2697 - RNA, 21 nt, Artificial Sequence
  Synthetic construct
ugcuucguuuacuuugcucag

SEQ ID NO: 2698 - RNA, 21 nt, Artificial Sequence
  Synthetic construct
aaagcucauauuagacuccgg

SEQ ID NO: 2699 - RNA, 21 nt, Artificial Sequence
  Synthetic construct
ugucaguuuacaaaugcugaa

SEQ ID NO: 2700 - RNA, 21 nt, Artificial Sequence
  Synthetic construct
ugaacuucauuugcuugaguu

SEQ ID NO: 2701 - RNA, 21 nt, Artificial Sequence
  Synthetic construct
uccaccacccuaacacaacug

SEQ ID NO: 2702 - RNA, 21 nt, Artificial Sequence
  Synthetic construct
uauggugaaauaguagucaaa

SEQ ID NO: 2703 - RNA, 21 nt, Artificial Sequence
  Synthetic construct
aaugauuucaaagucagcuuu

SEQ ID NO: 2704 - RNA, 21 nt, Artificial Sequence
  Synthetic construct
ucacucuuguugccgaggcug

SEQ ID NO: 2705 - RNA, 21 nt, Artificial Sequence
  Synthetic construct
aagaacgaagucauuacccaa

SEQ ID NO: 2706 - RNA, 21 nt, Artificial Sequence
  Synthetic construct
uuuaaaugugguuucuccuau

SEQ ID NO: 2707 - RNA, 21 nt, Artificial Sequence
  Synthetic construct
aacauaaagaauaaauacuug

SEQ ID NO: 2708 - RNA, 21 nt, Artificial Sequence
  Synthetic construct
augcauuaguagcuacaggau

SEQ ID NO: 2709 - RNA, 21 nt, Artificial Sequence
  Synthetic construct
ucgccuauccacauccaucuc

SEQ ID NO: 2710 - RNA, 21 nt, Artificial Sequence
  Synthetic construct
aauguaucuauuuccuccugg

SEQ ID NO: 2711 - RNA, 21 nt, Artificial Sequence
  Synthetic construct
uauugucacucuuuauaucuc

SEQ ID NO: 2712 - RNA, 21 nt, Artificial Sequence
  Synthetic construct
uauucauccucaguggaggag

SEQ ID NO: 2713 - RNA, 21 nt, Artificial Sequence
  Synthetic construct
ugagugcugaagaaucccggu

SEQ ID NO: 2714 - RNA, 21 nt, Artificial Sequence
  Synthetic construct
ugacuucucuagguauagggu

SEQ ID NO: 2715 - RNA, 21 nt, Artificial Sequence
  Synthetic construct
ucauuuggucacuuaaaggag

SEQ ID NO: 2716 - RNA, 21 nt, Artificial Sequence
  Synthetic construct
uuaucuuuguuuacuuaaugu

SEQ ID NO: 2717 - RNA, 21 nt, Artificial Sequence
  Synthetic construct
auauuauuaucaaaucuuggu

SEQ ID NO: 2718 - RNA, 21 nt, Artificial Sequence
  Synthetic construct
uaagcaugaacacaccauauu

SEQ ID NO: 2719 - RNA, 21 nt, Artificial Sequence
  Synthetic construct
augaauaugguauuugcgggu

SEQ ID NO: 2720 - RNA, 21 nt, Artificial Sequence
  Synthetic construct
uuauuguaaagcaauauuaua

SEQ ID NO: 2721 - RNA, 21 nt, Artificial Sequence
  Synthetic construct
uguuucuuuggaaucauagaa

SEQ ID NO: 2722 - RNA, 21 nt, Artificial Sequence
  Synthetic construct
uacucucagaagauucaggaa

SEQ ID NO: 2723 - RNA, 21 nt, Artificial Sequence
  Synthetic construct
uccugaacacacauauuccuc

SEQ ID NO: 2724 - RNA, 21 nt, Artificial Sequence
  Synthetic construct
auggauucaaccacagaacga

SEQ ID NO: 2725 - RNA, 21 nt, Artificial Sequence
  Synthetic construct
ugcaagagggacuacucucua

SEQ ID NO: 2726 - RNA, 21 nt, Artificial Sequence
  Synthetic construct
uuccuaacucaggacauuuug

SEQ ID NO: 2727 - RNA, 21 nt, Artificial Sequence
  Synthetic construct
uauaacauaguaugcuucaaa

SEQ ID NO: 2728 - RNA, 21 nt, Artificial Sequence
  Synthetic construct
aauuucaguccucuuguucag

SEQ ID NO: 2729 - RNA, 21 nt, Artificial Sequence
  Synthetic construct
uuaguaauaaagcucauauua

SEQ ID NO: 2730 - RNA, 21 nt, Artificial Sequence
  Synthetic construct
ucacucuuuauaucucuaugg

SEQ ID NO: 2731 - RNA, 21 nt, Artificial Sequence
  Synthetic construct
uuucucuauguuggucaggcu

SEQ ID NO: 2732 - RNA, 21 nt, Artificial Sequence
  Synthetic construct
uauuaaggagauuaacaaccu

SEQ ID NO: 2733 - RNA, 21 nt, Artificial Sequence
  Synthetic construct
ucgcuguugauuuccucuugg

SEQ ID NO: 2734 - RNA, 21 nt, Artificial Sequence
  Synthetic construct
uauguuggaaguuuggaguaa

SEQ ID NO: 2735 - RNA, 21 nt, Artificial Sequence
  Synthetic construct
uaccugaaugauauacaguaa

SEQ ID NO: 2736 - RNA, 21 nt, Artificial Sequence
  Synthetic construct
uacacucaagacacagucaug

SEQ ID NO: 2737 - RNA, 21 nt, Artificial Sequence
  Synthetic construct
ucucugccuacagugaucuga

SEQ ID NO: 2738 - RNA, 21 nt, Artificial Sequence
  Synthetic construct
uuggguuauauucauuugguc

SEQ ID NO: 2739 - RNA, 21 nt, Artificial Sequence
  Synthetic construct
uagguauagggucugcuuuua

SEQ ID NO: 2740 - RNA, 21 nt, Artificial Sequence
  Synthetic construct
uucaaauuaauauuaccguuu

SEQ ID NO: 2741 - RNA, 21 nt, Artificial Sequence
  Synthetic construct
uauauaguuugcugaaacucu

SEQ ID NO: 2742 - RNA, 21 nt, Artificial Sequence
  Synthetic construct
uagucuccuaagaaagcgugu

SEQ ID NO: 2743 - RNA, 21 nt, Artificial Sequence
  Synthetic construct
aaucguaugcucaaagucuga

SEQ ID NO: 2744 - RNA, 21 nt, Artificial Sequence
  Synthetic construct
aucagaaaugcuaucuuuggu

SEQ ID NO: 2745 - RNA, 21 nt, Artificial Sequence
  Synthetic construct
uagaagcuguucucauuugaa

SEQ ID NO: 2746 - RNA, 21 nt, Artificial Sequence
  Synthetic construct
uuuaguaauaaagcucauauu

SEQ ID NO: 2747 - RNA, 21 nt, Artificial Sequence
  Synthetic construct
aaacacguacacuauauaguu

SEQ ID NO: 2748 - RNA, 21 nt, Artificial Sequence
  Synthetic construct
aaugcuucuuagcuucucuaa

SEQ ID NO: 2749 - RNA, 21 nt, Artificial Sequence
  Synthetic construct
uauugaaauuagugggacuug

SEQ ID NO: 2750 - RNA, 21 nt, Artificial Sequence
  Synthetic construct
auuuggauagacucaccugug

SEQ ID NO: 2751 - RNA, 21 nt, Artificial Sequence
  Synthetic construct
uaucuaaauaauuaacaauau

SEQ ID NO: 2752 - RNA, 21 nt, Artificial Sequence
  Synthetic construct
uuuccuagguucagaaccuga

SEQ ID NO: 2753 - RNA, 21 nt, Artificial Sequence
  Synthetic construct
auaaugaauaugguauuugcg

SEQ ID NO: 2754 - RNA, 21 nt, Artificial Sequence
  Synthetic construct
uaagaaguuucuauucauuug

SEQ ID NO: 2755 - RNA, 21 nt, Artificial Sequence
  Synthetic construct
uaaagcaauauuauaacaaua

SEQ ID NO: 2756 - RNA, 21 nt, Artificial Sequence
  Synthetic construct
aacaggaagcaauuucguguu

SEQ ID NO: 2757 - RNA, 21 nt, Artificial Sequence
  Synthetic construct
uucacucuuguugccgaggcu

SEQ ID NO: 2758 - RNA, 21 nt, Artificial Sequence
  Synthetic construct
uuaaugauuucaaagucagcu

SEQ ID NO: 2759 - RNA, 21 nt, Artificial Sequence
  Synthetic construct
uaagcagcauaucugagguga

SEQ ID NO: 2760 - RNA, 21 nt, Artificial Sequence
  Synthetic construct
uaugggauagcauuugccuga

SEQ ID NO: 2761 - RNA, 21 nt, Artificial Sequence
  Synthetic construct
ucucagagaaagucccaucuu

SEQ ID NO: 2762 - RNA, 21 nt, Artificial Sequence
  Synthetic construct
uugcagauucaguuagacauu

SEQ ID NO: 2763 - RNA, 21 nt, Artificial Sequence
  Synthetic construct
uagcaauggaaugugcuucac

SEQ ID NO: 2764 - RNA, 21 nt, Artificial Sequence
  Synthetic construct
uccauuauuuccaaguuccca

SEQ ID NO: 2765 - RNA, 21 nt, Artificial Sequence
  Synthetic construct
uucacaggaaaggagaagcuc

SEQ ID NO: 2766 - RNA, 21 nt, Artificial Sequence
  Synthetic construct
ugacuguuucuuuggaaucau

SEQ ID NO: 2767 - RNA, 21 nt, Artificial Sequence
  Synthetic construct
uauguuucauaagcacaagag

SEQ ID NO: 2768 - RNA, 21 nt, Artificial Sequence
  Synthetic construct
aguagcuuagauaaagaccaa

SEQ ID NO: 2769 - RNA, 21 nt, Artificial Sequence
  Synthetic construct
ugugcuucucacccuucccug

SEQ ID NO: 2770 - RNA, 21 nt, Artificial Sequence
  Synthetic construct
uuuaucuugcaaguucaaccc

SEQ ID NO: 2771 - RNA, 21 nt, Artificial Sequence
  Synthetic construct
aaauaauuaacaauauuaggg

SEQ ID NO: 2772 - RNA, 21 nt, Artificial Sequence
  Synthetic construct
uccacauccaucucaagacag

SEQ ID NO: 2773 - RNA, 21 nt, Artificial Sequence
  Synthetic construct
acacagucaugcacaauccau

SEQ ID NO: 2774 - RNA, 21 nt, Artificial Sequence
  Synthetic construct
auuaauuugucaacauuucuc

SEQ ID NO: 2775 - RNA, 21 nt, Artificial Sequence
  Synthetic construct
ucugaagggucacugcuccaa

SEQ ID NO: 2776 - RNA, 21 nt, Artificial Sequence
  Synthetic construct
aacagcuuguggguucuucuu

SEQ ID NO: 2777 - RNA, 21 nt, Artificial Sequence
  Synthetic construct
uaggaaauacaccaguggggu

SEQ ID NO: 2778 - RNA, 21 nt, Artificial Sequence
  Synthetic construct
auauuauagaaucucucagaa

SEQ ID NO: 2779 - RNA, 21 nt, Artificial Sequence
  Synthetic construct
ugagaaacagcuucuuucuaa

SEQ ID NO: 2780 - RNA, 21 nt, Artificial Sequence
  Synthetic construct
ugggauuacagguaugagcca

SEQ ID NO: 2781 - RNA, 21 nt, Artificial Sequence
  Synthetic construct
uuagguucacucuuagcaguc

SEQ ID NO: 2782 - RNA, 21 nt, Artificial Sequence
  Synthetic construct
ugcuguauaaacaguaccuga

SEQ ID NO: 2783 - RNA, 21 nt, Artificial Sequence
  Synthetic construct
uagauggauggauguaccuug

SEQ ID NO: 2784 - RNA, 21 nt, Artificial Sequence
  Synthetic construct
ucuucuucuguuccaauuuug

SEQ ID NO: 2785 - RNA, 21 nt, Artificial Sequence
  Synthetic construct
uggucucgaacuccugaccuc

SEQ ID NO: 2786 - RNA, 21 nt, Artificial Sequence
  Synthetic construct
uaauccaaaguuacagaagaa

SEQ ID NO: 2787 - RNA, 21 nt, Artificial Sequence
  Synthetic construct
auauuaacugcaaguagcuua

SEQ ID NO: 2788 - RNA, 21 nt, Artificial Sequence
  Synthetic construct
aaggauuucaguauucuacau

SEQ ID NO: 2789 - RNA, 21 nt, Artificial Sequence
  Synthetic construct
uugagcugagaaauaucauuu

SEQ ID NO: 2790 - RNA, 21 nt, Artificial Sequence
  Synthetic construct
uggagcugugguugagugcug

SEQ ID NO: 2791 - RNA, 21 nt, Artificial Sequence
  Synthetic construct
uuccuaaccagguauugggcu

SEQ ID NO: 2792 - RNA, 21 nt, Artificial Sequence
  Synthetic construct
aucaucaauaaugaauauggu

SEQ ID NO: 2793 - RNA, 21 nt, Artificial Sequence
  Synthetic construct
agaacaucuagaacagcuugu

SEQ ID NO: 2794 - RNA, 21 nt, Artificial Sequence
  Synthetic construct
uaccucauuauuaaaguucuc

SEQ ID NO: 2795 - RNA, 21 nt, Artificial Sequence
  Synthetic construct
ucauuuauagacaaauaucuc

SEQ ID NO: 2796 - RNA, 21 nt, Artificial Sequence
  Synthetic construct
aauaaacuguuaacaaucugg

SEQ ID NO: 2797 - RNA, 21 nt, Artificial Sequence
  Synthetic construct
uacugcuggugaagcaaugga

SEQ ID NO: 2798 - RNA, 21 nt, Artificial Sequence
  Synthetic construct
ucuccuaugaggauuuccuag

SEQ ID NO: 2799 - RNA, 21 nt, Artificial Sequence
  Synthetic construct
uaacucuccaauacagggaag

SEQ ID NO: 2800 - RNA, 21 nt, Artificial Sequence
  Synthetic construct
acaauucugauaaacaaugaa

SEQ ID NO: 2801 - RNA, 21 nt, Artificial Sequence
  Synthetic construct
uauuagaaauauacauaacuc

SEQ ID NO: 2802 - RNA, 21 nt, Artificial Sequence
  Synthetic construct
auagauguaaggaucaggugg

SEQ ID NO: 2803 - RNA, 21 nt, Artificial Sequence
  Synthetic construct
uguauuucugguuguugacug

SEQ ID NO: 2804 - RNA, 21 nt, Artificial Sequence
  Synthetic construct
auggugacugauuugagggga

SEQ ID NO: 2805 - RNA, 21 nt, Artificial Sequence
  Synthetic construct
aaugaauaugguauuugcggg

SEQ ID NO: 2806 - RNA, 21 nt, Artificial Sequence
  Synthetic construct
acucuuuauaucucuauggau

SEQ ID NO: 2807 - RNA, 21 nt, Artificial Sequence
  Synthetic construct
uuccagcaguguacucaucau

SEQ ID NO: 2808 - RNA, 21 nt, Artificial Sequence
  Synthetic construct
uuguaucauaaguaaaugaug

SEQ ID NO: 2809 - RNA, 21 nt, Artificial Sequence
  Synthetic construct
uaaucucuacugugcuucuca

SEQ ID NO: 2810 - RNA, 21 nt, Artificial Sequence
  Synthetic construct
auguucacacaguacuugcuc

SEQ ID NO: 2811 - RNA, 21 nt, Artificial Sequence
  Synthetic construct
uuugagugcaggaaauccaaa

SEQ ID NO: 2812 - RNA, 21 nt, Artificial Sequence
  Synthetic construct
aauggaaugugcuucaccggg

SEQ ID NO: 2813 - RNA, 21 nt, Artificial Sequence
  Synthetic construct
ucucucaggauucuggagcuc

SEQ ID NO: 2814 - RNA, 21 nt, Artificial Sequence
  Synthetic construct
aaacucuaaagaaagugcuuu

SEQ ID NO: 2815 - RNA, 21 nt, Artificial Sequence
  Synthetic construct
ucuuggguacuaaaucuguug

SEQ ID NO: 2816 - RNA, 21 nt, Artificial Sequence
  Synthetic construct
aauuaaacucuagaaagccca

SEQ ID NO: 2817 - RNA, 21 nt, Artificial Sequence
  Synthetic construct
auauuuacaaugacacacaca

SEQ ID NO: 2818 - RNA, 21 nt, Artificial Sequence
  Synthetic construct
uucuuccucuucaucuucuuc

SEQ ID NO: 2819 - RNA, 21 nt, Artificial Sequence
  Synthetic construct
uaucuccugauguaaagcuca

SEQ ID NO: 2820 - RNA, 21 nt, Artificial Sequence
  Synthetic construct
uuugcugaaacucuaaagaaa

SEQ ID NO: 2821 - RNA, 21 nt, Artificial Sequence
  Synthetic construct
uuggugcgauaacugguggug

SEQ ID NO: 2822 - RNA, 21 nt, Artificial Sequence
  Synthetic construct
uaauuauuuacacgaucuuug

SEQ ID NO: 2823 - RNA, 21 nt, Artificial Sequence
  Synthetic construct
uauuuccuccugguaugccua

SEQ ID NO: 2824 - RNA, 21 nt, Artificial Sequence
  Synthetic construct
acaaauaaauuacauaaucug

SEQ ID NO: 2825 - RNA, 21 nt, Artificial Sequence
  Synthetic construct
auuuacaugaauacaaauuua

SEQ ID NO: 2826 - RNA, 21 nt, Artificial Sequence
  Synthetic construct
uacacagacacuccgcagaua

SEQ ID NO: 2827 - RNA, 21 nt, Artificial Sequence
  Synthetic construct
uggguucuucuucuguuccaa

SEQ ID NO: 2828 - RNA, 21 nt, Artificial Sequence
  Synthetic construct
uggauccuugcuaacaacauu

SEQ ID NO: 2829 - RNA, 21 nt, Artificial Sequence
  Synthetic construct
ucucugcaacuuguaaguguu

SEQ ID NO: 2830 - RNA, 21 nt, Artificial Sequence
  Synthetic construct
uacaugaauacaaauuuauaa

SEQ ID NO: 2831 - RNA, 21 nt, Artificial Sequence
  Synthetic construct
ucaaguuacucgauuguacca

SEQ ID NO: 2832 - RNA, 21 nt, Artificial Sequence
  Synthetic construct
ucugugaccacaucagucaga

SEQ ID NO: 2833 - RNA, 21 nt, Artificial Sequence
  Synthetic construct
auaacucuccaauacagggaa

SEQ ID NO: 2834 - RNA, 21 nt, Artificial Sequence
  Synthetic construct
uucacuacacaugguuuacag

SEQ ID NO: 2835 - RNA, 21 nt, Artificial Sequence
  Synthetic construct
uaacugcaacauaagagacuc

SEQ ID NO: 2836 - RNA, 21 nt, Artificial Sequence
  Synthetic construct
aacugauuucaauuaucugug

SEQ ID NO: 2837 - RNA, 21 nt, Artificial Sequence
  Synthetic construct
ugcuguucuuaauugcuuccu

SEQ ID NO: 2838 - RNA, 21 nt, Artificial Sequence
  Synthetic construct
ucucaaugcuaauagcaugua

SEQ ID NO: 2839 - RNA, 21 nt, Artificial Sequence
  Synthetic construct
auuuacaaugacacacacacg

SEQ ID NO: 2840 - RNA, 21 nt, Artificial Sequence
  Synthetic construct
auacaguaauauccuguugga

SEQ ID NO: 2841 - RNA, 21 nt, Artificial Sequence
  Synthetic construct
augaggauuuccuagguucag

SEQ ID NO: 2842 - RNA, 21 nt, Artificial Sequence
  Synthetic construct
aacuucuauugaaauuagugg

SEQ ID NO: 2843 - RNA, 21 nt, Artificial Sequence
  Synthetic construct
ugcaucuuugagaaaccuuuu

SEQ ID NO: 2844 - RNA, 21 nt, Artificial Sequence
  Synthetic construct
ucagaaaugcuaucuuugguu

SEQ ID NO: 2845 - RNA, 21 nt, Artificial Sequence
  Synthetic construct
aucugcaacagauguuaucaa

SEQ ID NO: 2846 - RNA, 21 nt, Artificial Sequence
  Synthetic construct
auugcaacucuauuagggcau

SEQ ID NO: 2847 - RNA, 21 nt, Artificial Sequence
  Synthetic construct
uguaaagcucauguauuucug

SEQ ID NO: 2848 - RNA, 21 nt, Artificial Sequence
  Synthetic construct
agauuuggauagacucaccug

SEQ ID NO: 2849 - RNA, 21 nt, Artificial Sequence
  Synthetic construct
uuccaccauuucaauugccau

SEQ ID NO: 2850 - RNA, 21 nt, Artificial Sequence
  Synthetic construct
uuacucgauuguaccaaaugu

SEQ ID NO: 2851 - RNA, 21 nt, Artificial Sequence
  Synthetic construct
uuugcucaggagugaucuggg

SEQ ID NO: 2852 - RNA, 21 nt, Artificial Sequence
  Synthetic construct
uaacauaguaugcuucaaauu

SEQ ID NO: 2853 - RNA, 21 nt, Artificial Sequence
  Synthetic construct
ucaaaucuugguacaaagugg

SEQ ID NO: 2854 - RNA, 21 nt, Artificial Sequence
  Synthetic construct
aaucuugguacaaagugguag

SEQ ID NO: 2855 - RNA, 21 nt, Artificial Sequence
  Synthetic construct
uuccuucuuggguugcuguug

SEQ ID NO: 2856 - RNA, 21 nt, Artificial Sequence
  Synthetic construct
gagaacaucuagaacagcuug

SEQ ID NO: 2857 - RNA, 21 nt, Artificial Sequence
  Synthetic construct
auuauuaaaguucucaccuaa

SEQ ID NO: 2858 - RNA, 21 nt, Artificial Sequence
  Synthetic construct
aaggcuugcagucuuagcggc

SEQ ID NO: 2859 - RNA, 21 nt, Artificial Sequence
  Synthetic construct
ugcauuaguagcuacaggauu

SEQ ID NO: 2860 - RNA, 21 nt, Artificial Sequence
  Synthetic construct
agaauuucacuacacaugguu

SEQ ID NO: 2861 - RNA, 21 nt, Artificial Sequence
  Synthetic construct
uuguaaucccuguuuauguua

SEQ ID NO: 2862 - RNA, 21 nt, Artificial Sequence
  Synthetic construct
ugguuguugacuguuucuuug

SEQ ID NO: 2863 - RNA, 21 nt, Artificial Sequence
  Synthetic construct
uuagauggucucccuugcucu

SEQ ID NO: 2864 - RNA, 21 nt, Artificial Sequence
  Synthetic construct
ucuggagcucuggaguuccau

SEQ ID NO: 2865 - RNA, 21 nt, Artificial Sequence
  Synthetic construct
acucacaaugcuucuuagcuu

SEQ ID NO: 2866 - RNA, 21 nt, Artificial Sequence
  Synthetic construct
auaacuucuauugaaauuagu

SEQ ID NO: 2867 - RNA, 21 nt, Artificial Sequence
  Synthetic construct
ucaacauugaaagaugugccc

SEQ ID NO: 2868 - RNA, 21 nt, Artificial Sequence
  Synthetic construct
ucaucacccaccaaguagcua

SEQ ID NO: 2869 - RNA, 21 nt, Artificial Sequence
  Synthetic construct
aagucagucaauuuaacagag

SEQ ID NO: 2870 - RNA, 21 nt, Artificial Sequence
  Synthetic construct
uagggcauggacuuccacaug

SEQ ID NO: 2871 - RNA, 21 nt, Artificial Sequence
  Synthetic construct
aucucagcucaccacaaccuc

SEQ ID NO: 2872 - RNA, 21 nt, Artificial Sequence
  Synthetic construct
auguuaugaguauaaucccag

SEQ ID NO: 2873 - RNA, 21 nt, Artificial Sequence
  Synthetic construct
uuucauugaauuucccggcac

SEQ ID NO: 2874 - RNA, 21 nt, Artificial Sequence
  Synthetic construct
uauuccauuauuuccaaguuc

SEQ ID NO: 2875 - RNA, 21 nt, Artificial Sequence
  Synthetic construct
aagaauauugucacucuuuau

SEQ ID NO: 2876 - RNA, 21 nt, Artificial Sequence
  Synthetic construct
agaaauauacauaacucucca

SEQ ID NO: 2877 - RNA, 21 nt, Artificial Sequence
  Synthetic construct
uuacagaagaauuucacuaca

SEQ ID NO: 2878 - RNA, 21 nt, Artificial Sequence
  Synthetic construct
uauaaucccaguagacaucac

SEQ ID NO: 2879 - RNA, 21 nt, Artificial Sequence
  Synthetic construct
uuugucaacauuucucaaugc

SEQ ID NO: 2880 - RNA, 21 nt, Artificial Sequence
  Synthetic construct
uggucuuggugcgauaacugg

SEQ ID NO: 2881 - RNA, 21 nt, Artificial Sequence
  Synthetic construct
aaguaaaugaugauuaaugua

SEQ ID NO: 2882 - RNA, 21 nt, Artificial Sequence
  Synthetic construct
uacuuauuagaaauauacaua

SEQ ID NO: 2883 - RNA, 21 nt, Artificial Sequence
  Synthetic construct
auaucucuauggaucaccugg

SEQ ID NO: 2884 - RNA, 21 nt, Artificial Sequence
  Synthetic construct
uugacuguuucuuuggaauca

SEQ ID NO: 2885 - RNA, 21 nt, Artificial Sequence
  Synthetic construct
ucuguauugagaaugaccaau

SEQ ID NO: 2886 - RNA, 21 nt, Artificial Sequence
  Synthetic construct
uucaaccugagagucuguuaa

SEQ ID NO: 2887 - RNA, 21 nt, Artificial Sequence
  Synthetic construct
uuguuuaaugauuucaaaguc

SEQ ID NO: 2888 - RNA, 21 nt, Artificial Sequence
  Synthetic construct
auuccgaaacagaaauaggug

SEQ ID NO: 2889 - RNA, 21 nt, Artificial Sequence
  Synthetic construct
acuaaaucuguugaacauguu

SEQ ID NO: 2890 - RNA, 21 nt, Artificial Sequence
  Synthetic construct
uaaucagaggagucaggcugg

SEQ ID NO: 2891 - RNA, 21 nt, Artificial Sequence
  Synthetic construct
aaguauaacauaguaugcuuc

SEQ ID NO: 2892 - RNA, 21 nt, Artificial Sequence
  Synthetic construct
uacacgaucuuugagcugaga

SEQ ID NO: 2893 - RNA, 21 nt, Artificial Sequence
  Synthetic construct
aaaugcugaauuucaguccuc

SEQ ID NO: 2894 - RNA, 21 nt, Artificial Sequence
  Synthetic construct
cuaagcagcauaucugaggug

SEQ ID NO: 2895 - RNA, 21 nt, Artificial Sequence
  Synthetic construct
uucuauucauuugaaagguaa

SEQ ID NO: 2896 - RNA, 21 nt, Artificial Sequence
  Synthetic construct
uuugcagauucaguuagacau

SEQ ID NO: 2897 - RNA, 21 nt, Artificial Sequence
  Synthetic construct
uagcuuuaacuuauagauaau

SEQ ID NO: 2898 - RNA, 21 nt, Artificial Sequence
  Synthetic construct
uaaucccaguagacaucacua

SEQ ID NO: 2899 - RNA, 21 nt, Artificial Sequence
  Synthetic construct
uauauucauuuggucacuuaa

SEQ ID NO: 2900 - RNA, 21 nt, Artificial Sequence
  Synthetic construct
uaguaauaaagcucauauuag

SEQ ID NO: 2901 - RNA, 21 nt, Artificial Sequence
  Synthetic construct
uucucuagguauagggucugc

SEQ ID NO: 2902 - RNA, 21 nt, Artificial Sequence
  Synthetic construct
ucaaugcauuaguagcuacag

SEQ ID NO: 2903 - RNA, 21 nt, Artificial Sequence
  Synthetic construct
gugcuguauaaacaguaccug

SEQ ID NO: 2904 - RNA, 21 nt, Artificial Sequence
  Synthetic construct
aauaugcugaacugaaagcau

SEQ ID NO: 2905 - RNA, 21 nt, Artificial Sequence
  Synthetic construct
uaauaaauagauauaugguga

SEQ ID NO: 2906 - RNA, 21 nt, Artificial Sequence
  Synthetic construct
auuaaacucuagaaagcccag

SEQ ID NO: 2907 - RNA, 21 nt, Artificial Sequence
  Synthetic construct
aucugacucauucucuacuau

SEQ ID NO: 2908 - RNA, 21 nt, Artificial Sequence
  Synthetic construct
agacagcugcuaucuguccuu

SEQ ID NO: 2909 - RNA, 21 nt, Artificial Sequence
  Synthetic construct
aauucugucggacugacauuu

SEQ ID NO: 2910 - RNA, 21 nt, Artificial Sequence
  Synthetic construct
uauuuguuuaaugauuucaaa

SEQ ID NO: 2911 - RNA, 21 nt, Artificial Sequence
  Synthetic construct
ugucaacauuucucaaugcua

SEQ ID NO: 2912 - RNA, 21 nt, Artificial Sequence
  Synthetic construct
uaguuugcugaaacucuaaag

SEQ ID NO: 2913 - RNA, 21 nt, Artificial Sequence
  Synthetic construct
uguuucauaagcacaagagag

SEQ ID NO: 2914 - RNA, 21 nt, Artificial Sequence
  Synthetic construct
augugacaggauuucaccguu

SEQ ID NO: 2915 - RNA, 21 nt, Artificial Sequence
  Synthetic construct
auacugcaaauuaagaagccu

SEQ ID NO: 2916 - RNA, 21 nt, Artificial Sequence
  Synthetic construct
uaauugcaagucauaacuucu

SEQ ID NO: 2917 - RNA, 21 nt, Artificial Sequence
  Synthetic construct
uuauccagaccgucagacauu

SEQ ID NO: 2918 - RNA, 21 nt, Artificial Sequence
  Synthetic construct
uuuauuugguacugcugguga

SEQ ID NO: 2919 - RNA, 21 nt, Artificial Sequence
  Synthetic construct
aauugcuuccuuugcagcgau

SEQ ID NO: 2920 - RNA, 21 nt, Artificial Sequence
  Synthetic construct
uaagugacuugccuagcguca

SEQ ID NO: 2921 - RNA, 21 nt, Artificial Sequence
  Synthetic construct
aucaaaucuugguacaaagug

SEQ ID NO: 2922 - RNA, 21 nt, Artificial Sequence
  Synthetic construct
ucaugggauuaugacaacgca

SEQ ID NO: 2923 - RNA, 21 nt, Artificial Sequence
  Synthetic construct
uacaguuauauucuagcaagu

SEQ ID NO: 2924 - RNA, 21 nt, Artificial Sequence
  Synthetic construct
acaaguuguauagaauacucg

SEQ ID NO: 2925 - RNA, 21 nt, Artificial Sequence
  Synthetic construct
agaauuugagaacaucuagaa

SEQ ID NO: 2926 - RNA, 21 nt, Artificial Sequence
  Synthetic construct
uucaguuagacauuguuuaau

SEQ ID NO: 2927 - RNA, 21 nt, Artificial Sequence
  Synthetic construct
uaaaugaugauuaauguaucu

SEQ ID NO: 2928 - RNA, 21 nt, Artificial Sequence
  Synthetic construct
aaugauauacaguaauauccu

SEQ ID NO: 2929 - RNA, 21 nt, Artificial Sequence
  Synthetic construct
aagucauuacccaacauggug

SEQ ID NO: 2930 - RNA, 21 nt, Artificial Sequence
  Synthetic construct
ucuucuucuucuuccucuuca

SEQ ID NO: 2931 - RNA, 21 nt, Artificial Sequence
  Synthetic construct
uauuaacugcaaguagcuuag

SEQ ID NO: 2932 - RNA, 21 nt, Artificial Sequence
  Synthetic construct
ugguaguaaagaaguaccugg

SEQ ID NO: 2933 - RNA, 21 nt, Artificial Sequence
  Synthetic construct
uaaguucuguuuagauucuuu

SEQ ID NO: 2934 - RNA, 21 nt, Artificial Sequence
  Synthetic construct
uauaagaaguuucuauucauu

SEQ ID NO: 2935 - RNA, 21 nt, Artificial Sequence
  Synthetic construct
acaacauuaacguucuuuccu

SEQ ID NO: 2936 - RNA, 21 nt, Artificial Sequence
  Synthetic construct
uucaagacauuuaugaauaug

SEQ ID NO: 2937 - RNA, 21 nt, Artificial Sequence
  Synthetic construct
acaacuguaaaugaauuggaa

SEQ ID NO: 2938 - RNA, 21 nt, Artificial Sequence
  Synthetic construct
auuguuuaauauuaaacacau

SEQ ID NO: 2939 - RNA, 21 nt, Artificial Sequence
  Synthetic construct
uaaaucuguugaacauguugc

SEQ ID NO: 2940 - RNA, 21 nt, Artificial Sequence
  Synthetic construct
aacauugcugcccuguuuggg

SEQ ID NO: 2941 - RNA, 21 nt, Artificial Sequence
  Synthetic construct
uuucuuuggaaucauagaauu

SEQ ID NO: 2942 - RNA, 21 nt, Artificial Sequence
  Synthetic construct
ugaguucacuucaaaucccag

SEQ ID NO: 2943 - RNA, 21 nt, Artificial Sequence
  Synthetic construct
uaaacguuauaaauugucaaa

SEQ ID NO: 2944 - RNA, 21 nt, Artificial Sequence
  Synthetic construct
uagggcuuccuaaccagguau

SEQ ID NO: 2945 - RNA, 21 nt, Artificial Sequence
  Synthetic construct
uguaaagcaauauuauaacaa

SEQ ID NO: 2946 - RNA, 21 nt, Artificial Sequence
  Synthetic construct
uuaaaugugguuucuccuaug

SEQ ID NO: 2947 - RNA, 21 nt, Artificial Sequence
  Synthetic construct
ucuuggugcgauaacuggugg

SEQ ID NO: 2948 - RNA, 21 nt, Artificial Sequence
  Synthetic construct
ucagaaccugaacucaccuag

SEQ ID NO: 2949 - RNA, 21 nt, Artificial Sequence
  Synthetic construct
uuucuugggauaugauuguaa

SEQ ID NO: 2950 - RNA, 21 nt, Artificial Sequence
  Synthetic construct
uuaauauuaccguuucauuuu

SEQ ID NO: 2951 - RNA, 21 nt, Artificial Sequence
  Synthetic construct
ugagcugagaaauaucauuua

SEQ ID NO: 2952 - RNA, 21 nt, Artificial Sequence
  Synthetic construct
uuguggguucuucuucuguuc

SEQ ID NO: 2953 - RNA, 21 nt, Artificial Sequence
  Synthetic construct
uugagcuuuauuuagauauac

SEQ ID NO: 2954 - RNA, 21 nt, Artificial Sequence
  Synthetic construct
agaccagauaucaacuuucgg

SEQ ID NO: 2955 - RNA, 21 nt, Artificial Sequence
  Synthetic construct
gaaauauacauaacucuccaa

SEQ ID NO: 2956 - RNA, 21 nt, Artificial Sequence
  Synthetic construct
aagauuuggauagacucaccu

SEQ ID NO: 2957 - RNA, 21 nt, Artificial Sequence
  Synthetic construct
ucuacuaucgcuguugauuuc

SEQ ID NO: 2958 - RNA, 21 nt, Artificial Sequence
  Synthetic construct
augguuuacagauaacacauu

SEQ ID NO: 2959 - RNA, 21 nt, Artificial Sequence
  Synthetic construct
uaucauaaguaaaugaugauu

SEQ ID NO: 2960 - RNA, 21 nt, Artificial Sequence
  Synthetic construct
auaaagcacaccacacacaag

SEQ ID NO: 2961 - RNA, 21 nt, Artificial Sequence
  Synthetic construct
ucagcucaccacaaccuccgc

SEQ ID NO: 2962 - RNA, 21 nt, Artificial Sequence
  Synthetic construct
aauagucuccuaagaaagcgu

SEQ ID NO: 2963 - RNA, 21 nt, Artificial Sequence
  Synthetic construct
uacagaguugaauguuuacua

SEQ ID NO: 2964 - RNA, 21 nt, Artificial Sequence
  Synthetic construct
uuccuagguucagaaccugaa

SEQ ID NO: 2965 - RNA, 21 nt, Artificial Sequence
  Synthetic construct
uuuggucacuuaaaggagugu

SEQ ID NO: 2966 - RNA, 21 nt, Artificial Sequence
  Synthetic construct
aaaggcuuagagaaacaacuu

SEQ ID NO: 2967 - RNA, 21 nt, Artificial Sequence
  Synthetic construct
aaauuagugggacuugcccua

SEQ ID NO: 2968 - RNA, 21 nt, Artificial Sequence
  Synthetic construct
aaauuacauaaucugagggag

SEQ ID NO: 2969 - RNA, 21 nt, Artificial Sequence
  Synthetic construct
auugcuucaaccacaauuuaa

SEQ ID NO: 2970 - RNA, 21 nt, Artificial Sequence
  Synthetic construct
uacaaguuguauagaauacuc

SEQ ID NO: 2971 - RNA, 21 nt, Artificial Sequence
  Synthetic construct
uaauuaacaauauuaggguuc

SEQ ID NO: 2972 - RNA, 21 nt, Artificial Sequence
  Synthetic construct
aacauaaacacguacacuaua

SEQ ID NO: 2973 - RNA, 21 nt, Artificial Sequence
  Synthetic construct
aacuuucggaccauaagcuuu

SEQ ID NO: 2974 - RNA, 21 nt, Artificial Sequence
  Synthetic construct
uuaugaguauaaucccaguag

SEQ ID NO: 2975 - RNA, 21 nt, Artificial Sequence
  Synthetic construct
ucucagaagauucaggaagug

SEQ ID NO: 2976 - RNA, 21 nt, Artificial Sequence
  Synthetic construct
ugauuaauguaucuauuuccu

SEQ ID NO: 2977 - RNA, 21 nt, Artificial Sequence
  Synthetic construct
aaucauagaauuugagaacau

SEQ ID NO: 2978 - RNA, 21 nt, Artificial Sequence
  Synthetic construct
acagcugacagucucucagga

SEQ ID NO: 2979 - RNA, 21 nt, Artificial Sequence
  Synthetic construct
ucauccucaguggaggagccg

SEQ ID NO: 2980 - RNA, 21 nt, Artificial Sequence
  Synthetic construct
acuagcaacaucaaagauuug

SEQ ID NO: 2981 - RNA, 21 nt, Artificial Sequence
  Synthetic construct
uagcaacaucaaagauuugga

SEQ ID NO: 2982 - RNA, 21 nt, Artificial Sequence
  Synthetic construct
caguauucuacauuuaucugg

SEQ ID NO: 2983 - RNA, 21 nt, Artificial Sequence
  Synthetic construct
aacacacauauuccucuccac

SEQ ID NO: 2984 - RNA, 21 nt, Artificial Sequence
  Synthetic construct
uuaaacucuagaaagcccagc

SEQ ID NO: 2985 - RNA, 21 nt, Artificial Sequence
  Synthetic construct
aacacaacugauuucaauuau

SEQ ID NO: 2986 - RNA, 21 nt, Artificial Sequence
  Synthetic construct
uagaaauaaacccauugagca

SEQ ID NO: 2987 - RNA, 21 nt, Artificial Sequence
  Synthetic construct
uacagauaacacauucugaca

SEQ ID NO: 2988 - RNA, 21 nt, Artificial Sequence
  Synthetic construct
uuggagcugugguugagugcu

SEQ ID NO: 2989 - RNA, 21 nt, Artificial Sequence
  Synthetic construct
aacgaguauagauugauuuug

SEQ ID NO: 2990 - RNA, 21 nt, Artificial Sequence
  Synthetic construct
ugaucugggcacagaacccaa

SEQ ID NO: 2991 - RNA, 21 nt, Artificial Sequence
  Synthetic construct
auggagaccaucccaagccaa

SEQ ID NO: 2992 - RNA, 21 nt, Artificial Sequence
  Synthetic construct
aguuagaaggaaguuauccuu

SEQ ID NO: 2993 - RNA, 21 nt, Artificial Sequence
  Synthetic construct
cuuauagauaauagucuccua

SEQ ID NO: 2994 - RNA, 21 nt, Artificial Sequence
  Synthetic construct
uaccuuugcuuaacugaauau

SEQ ID NO: 2995 - RNA, 21 nt, Artificial Sequence
  Synthetic construct
uucucuaagaucuccucaucu

SEQ ID NO: 2996 - RNA, 21 nt, Artificial Sequence
  Synthetic construct
ucaagacacagucaugcacaa

SEQ ID NO: 2997 - RNA, 21 nt, Artificial Sequence
  Synthetic construct
augacacacacacgagaucag

SEQ ID NO: 2998 - RNA, 21 nt, Artificial Sequence
  Synthetic construct
uggaauuccagugaauucccc

SEQ ID NO: 2999 - RNA, 21 nt, Artificial Sequence
  Synthetic construct
ucucucucucauuagagcagu

SEQ ID NO: 3000 - RNA, 21 nt, Artificial Sequence
  Synthetic construct
ugaauccuucagcaucacugu

SEQ ID NO: 3001 - RNA, 21 nt, Artificial Sequence
  Synthetic construct
auuaacugcaaguagcuuaga

SEQ ID NO: 3002 - RNA, 21 nt, Artificial Sequence
  Synthetic construct
uuccaagagaccagauaucaa

SEQ ID NO: 3003 - RNA, 21 nt, Artificial Sequence
  Synthetic construct
auaauuguaacuagcaaauau

SEQ ID NO: 3004 - RNA, 21 nt, Artificial Sequence
  Synthetic construct
uucagagcucagagacuggga

SEQ ID NO: 3005 - RNA, 21 nt, Artificial Sequence
  Synthetic construct
uuaucccacuacaucugacuc

SEQ ID NO: 3006 - RNA, 21 nt, Artificial Sequence
  Synthetic construct
aauaaauagauauauggugaa

SEQ ID NO: 3007 - RNA, 21 nt, Artificial Sequence
  Synthetic construct
ucucaguucccgcauuugcag

SEQ ID NO: 3008 - RNA, 21 nt, Artificial Sequence
  Synthetic construct
uuacaaaugcugaauuucagu

SEQ ID NO: 3009 - RNA, 21 nt, Artificial Sequence
  Synthetic construct
uguaaaugaauuggaaggcug

SEQ ID NO: 3010 - RNA, 21 nt, Artificial Sequence
  Synthetic construct
uagguucacucuuagcagucu

SEQ ID NO: 3011 - RNA, 21 nt, Artificial Sequence
  Synthetic construct
uuacccucuuuccagcagugu

SEQ ID NO: 3012 - RNA, 21 nt, Artificial Sequence
  Synthetic construct
uguugaagguucaucugcuuu

SEQ ID NO: 3013 - RNA, 21 nt, Artificial Sequence
  Synthetic construct
uuucaguccucuuguucagag

SEQ ID NO: 3014 - RNA, 21 nt, Artificial Sequence
  Synthetic construct
ucuuuggaaucauagaauuug

SEQ ID NO: 3015 - RNA, 21 nt, Artificial Sequence
  Synthetic construct
uaacucccaguuuacccucuu

SEQ ID NO: 3016 - RNA, 21 nt, Artificial Sequence
  Synthetic construct
ucuccuucuucuuauugguuu

SEQ ID NO: 3017 - RNA, 21 nt, Artificial Sequence
  Synthetic construct
uaggcuaguauuuaucccacu

SEQ ID NO: 3018 - RNA, 21 nt, Artificial Sequence
  Synthetic construct
uuaucucagggcacacuagca

SEQ ID NO: 3019 - RNA, 21 nt, Artificial Sequence
  Synthetic construct
aaauacuugaguuaaaucuuc

SEQ ID NO: 3020 - RNA, 21 nt, Artificial Sequence
  Synthetic construct
aguuauauucuagcaagugug

SEQ ID NO: 3021 - RNA, 21 nt, Artificial Sequence
  Synthetic construct
uaaacccauugagcaaaggaa

SEQ ID NO: 3022 - RNA, 21 nt, Artificial Sequence
  Synthetic construct
uacuaucgcuguugauuuccu

SEQ ID NO: 3023 - RNA, 21 nt, Artificial Sequence
  Synthetic construct
aauacagcugacagucucuca

SEQ ID NO: 3024 - RNA, 21 nt, Artificial Sequence
  Synthetic construct
ucuuucuccuucuucuuauug

SEQ ID NO: 3025 - RNA, 21 nt, Artificial Sequence
  Synthetic construct
ucaacuuucggaccauaagcu

SEQ ID NO: 3026 - RNA, 21 nt, Artificial Sequence
  Synthetic construct
uugagcaaaggaauauaauua

SEQ ID NO: 3027 - RNA, 21 nt, Artificial Sequence
  Synthetic construct
uugaaagaugugcccucguua

SEQ ID NO: 3028 - RNA, 21 nt, Artificial Sequence
  Synthetic construct
auuucucucugcaacuuguaa

SEQ ID NO: 3029 - RNA, 21 nt, Artificial Sequence
  Synthetic construct
ugaaagaaaucugaauaacau

SEQ ID NO: 3030 - RNA, 21 nt, Artificial Sequence
  Synthetic construct
ucuuucuaauacuuauuagaa

SEQ ID NO: 3031 - RNA, 21 nt, Artificial Sequence
  Synthetic construct
aacugcaacauaagagacuca

SEQ ID NO: 3032 - RNA, 21 nt, Artificial Sequence
  Synthetic construct
uuaauuuagguaucauuaucu

SEQ ID NO: 3033 - RNA, 21 nt, Artificial Sequence
  Synthetic construct
agaaauaucauuuauagacaa

SEQ ID NO: 3034 - RNA, 21 nt, Artificial Sequence
  Synthetic construct
cauauaaggaauucugucgga

SEQ ID NO: 3035 - RNA, 21 nt, Artificial Sequence
  Synthetic construct
aaguguuuagguucacucuua

SEQ ID NO: 3036 - RNA, 21 nt, Artificial Sequence
  Synthetic construct
ugaucugaagggucacugcuc

SEQ ID NO: 3037 - RNA, 21 nt, Artificial Sequence
  Synthetic construct
ugaccucuuuauuugguacug

SEQ ID NO: 3038 - RNA, 21 nt, Artificial Sequence
  Synthetic construct
uacucgaaggaugggcugcua

SEQ ID NO: 3039 - RNA, 21 nt, Artificial Sequence
  Synthetic construct
auuaacaaccugguuuacuca

SEQ ID NO: 3040 - RNA, 21 nt, Artificial Sequence
  Synthetic construct
ugaguuaaaucuucuuacaug

SEQ ID NO: 3041 - RNA, 21 nt, Artificial Sequence
  Synthetic construct
auuccuucuuggguugcuguu

SEQ ID NO: 3042 - RNA, 21 nt, Artificial Sequence
  Synthetic construct
aaugcauuaguagcuacagga

SEQ ID NO: 3043 - RNA, 21 nt, Artificial Sequence
  Synthetic construct
acuagcaaauaucucugcccu

SEQ ID NO: 3044 - RNA, 21 nt, Artificial Sequence
  Synthetic construct
ugugacaggauuucaccguuu

SEQ ID NO: 3045 - RNA, 21 nt, Artificial Sequence
  Synthetic construct
aacacauucccaaugcauguu

SEQ ID NO: 3046 - RNA, 21 nt, Artificial Sequence
  Synthetic construct
aauaauuuguaucauaaguaa

SEQ ID NO: 3047 - RNA, 21 nt, Artificial Sequence
  Synthetic construct
auuauuaugaacuucauuugc

SEQ ID NO: 3048 - RNA, 21 nt, Artificial Sequence
  Synthetic construct
uaugcugaacugaaagcauaa

SEQ ID NO: 3049 - RNA, 21 nt, Artificial Sequence
  Synthetic construct
auaaacacguacacuauauag

SEQ ID NO: 3050 - RNA, 21 nt, Artificial Sequence
  Synthetic construct
uuacugcugguauuaugggau

SEQ ID NO: 3051 - RNA, 21 nt, Artificial Sequence
  Synthetic construct
aucuaguccaauacacuuauu

SEQ ID NO: 3052 - RNA, 21 nt, Artificial Sequence
  Synthetic construct
ucuuagcuucucuaagaucuc

SEQ ID NO: 3053 - RNA, 21 nt, Artificial Sequence
  Synthetic construct
ugcugaauuucaguccucuug

SEQ ID NO: 3054 - RNA, 21 nt, Artificial Sequence
  Synthetic construct
acuaucgcuguugauuuccuc

SEQ ID NO: 3055 - RNA, 21 nt, Artificial Sequence
  Synthetic construct
acacauauuccucuccacuuu

SEQ ID NO: 3056 - RNA, 21 nt, Artificial Sequence
  Synthetic construct
uucuuucuaauacuuauuaga

SEQ ID NO: 3057 - RNA, 21 nt, Artificial Sequence
  Synthetic construct
uggaaugugcuucaccgggga

SEQ ID NO: 3058 - RNA, 21 nt, Artificial Sequence
  Synthetic construct
ucauugauguuugucauuuuu

SEQ ID NO: 3059 - RNA, 21 nt, Artificial Sequence
  Synthetic construct
aaaugaugauuaauguaucua

SEQ ID NO: 3060 - RNA, 21 nt, Artificial Sequence
  Synthetic construct
aauuugucaacauuucucaau

SEQ ID NO: 3061 - RNA, 21 nt, Artificial Sequence
  Synthetic construct
uucaguauucuacauuuaucu

SEQ ID NO: 3062 - RNA, 21 nt, Artificial Sequence
  Synthetic construct
ucuaguccaauacacuuauuu

SEQ ID NO: 3063 - RNA, 21 nt, Artificial Sequence
  Synthetic construct
acaacuuucuguaauuuacaa

SEQ ID NO: 3064 - RNA, 21 nt, Artificial Sequence
  Synthetic construct
uucugguuguugacuguuucu

SEQ ID NO: 3065 - RNA, 21 nt, Artificial Sequence
  Synthetic construct
uucugugaagaucuuaucauc

SEQ ID NO: 3066 - RNA, 21 nt, Artificial Sequence
  Synthetic construct
uuaauuccuucuuggguugcu

SEQ ID NO: 3067 - RNA, 21 nt, Artificial Sequence
  Synthetic construct
aucucugcccugcaugcucug

SEQ ID NO: 3068 - RNA, 21 nt, Artificial Sequence
  Synthetic construct
ugugguuucuccuaugaggau

SEQ ID NO: 3069 - RNA, 21 nt, Artificial Sequence
  Synthetic construct
auguaacugaucucuuucccc

SEQ ID NO: 3070 - RNA, 21 nt, Artificial Sequence
  Synthetic construct
uacagaagaauuucacuacac

SEQ ID NO: 3071 - RNA, 21 nt, Artificial Sequence
  Synthetic construct
uuaagaagccuucuauaacac

SEQ ID NO: 3072 - RNA, 21 nt, Artificial Sequence
  Synthetic construct
aaaugcuaucuuugguuccca

SEQ ID NO: 3073 - RNA, 21 nt, Artificial Sequence
  Synthetic construct
uaagaagccuucuauaacaca

SEQ ID NO: 3074 - RNA, 21 nt, Artificial Sequence
  Synthetic construct
uuuggaguaaucgugcccauu

SEQ ID NO: 3075 - RNA, 21 nt, Artificial Sequence
  Synthetic construct
auuaaggccucucucucucau

SEQ ID NO: 3076 - RNA, 21 nt, Artificial Sequence
  Synthetic construct
auuugaaagguaaagaacccc

SEQ ID NO: 3077 - RNA, 21 nt, Artificial Sequence
  Synthetic construct
uuuguuuaaaugugguuucuc

SEQ ID NO: 3078 - RNA, 21 nt, Artificial Sequence
  Synthetic construct
uaucagauacaaugcccugag

SEQ ID NO: 3079 - RNA, 21 nt, Artificial Sequence
  Synthetic construct
uuugguacugcuggugaagca

SEQ ID NO: 3080 - RNA, 21 nt, Artificial Sequence
  Synthetic construct
aacacaacacuaugaagaggg

SEQ ID NO: 3081 - RNA, 21 nt, Artificial Sequence
  Synthetic construct
uuucaagacauuuaugaauau

SEQ ID NO: 3082 - RNA, 21 nt, Artificial Sequence
  Synthetic construct
uggauccuucucaacuuguuu

SEQ ID NO: 3083 - RNA, 21 nt, Artificial Sequence
  Synthetic construct
uauaaacaguaccugaugccc

SEQ ID NO: 3084 - RNA, 21 nt, Artificial Sequence
  Synthetic construct
uagcaggaugucacaguuuca

SEQ ID NO: 3085 - RNA, 21 nt, Artificial Sequence
  Synthetic construct
aaaucuguugaacauguugcc

SEQ ID NO: 3086 - RNA, 21 nt, Artificial Sequence
  Synthetic construct
uucaaccacagaacgaguaua

SEQ ID NO: 3087 - RNA, 21 nt, Artificial Sequence
  Synthetic construct
auguacauaaguucuguuuag

SEQ ID NO: 3088 - RNA, 21 nt, Artificial Sequence
  Synthetic construct
ucugaaggaagagagaucucu

SEQ ID NO: 3089 - RNA, 21 nt, Artificial Sequence
  Synthetic construct
ugucaucagaaaugcuaucuu

SEQ ID NO: 3090 - RNA, 21 nt, Artificial Sequence
  Synthetic construct
aucguaugcucaaagucugaa

SEQ ID NO: 3091 - RNA, 21 nt, Artificial Sequence
  Synthetic construct
uucuucuucuuccucuucauc

SEQ ID NO: 3092 - RNA, 21 nt, Artificial Sequence
  Synthetic construct
ucucucucauuagagcagugu

SEQ ID NO: 3093 - RNA, 21 nt, Artificial Sequence
  Synthetic construct
cacacaagcacacacauugaa

SEQ ID NO: 3094 - RNA, 21 nt, Artificial Sequence
  Synthetic construct
augggaagugguuuggagcug

SEQ ID NO: 3095 - RNA, 21 nt, Artificial Sequence
  Synthetic construct
uauagauaauagucuccuaag

SEQ ID NO: 3096 - RNA, 21 nt, Artificial Sequence
  Synthetic construct
gaauaaacuguuaacaaucug

SEQ ID NO: 3097 - RNA, 21 nt, Artificial Sequence
  Synthetic construct
ugcauguuggguuauauucau

SEQ ID NO: 3098 - RNA, 21 nt, Artificial Sequence
  Synthetic construct
ucuaagaucuccucaucuguc

SEQ ID NO: 3099 - RNA, 21 nt, Artificial Sequence
  Synthetic construct
uggaagugaccacuuuauggu

SEQ ID NO: 3100 - RNA, 21 nt, Artificial Sequence
  Synthetic construct
ucucuagguauagggucugcu

SEQ ID NO: 3101 - RNA, 21 nt, Artificial Sequence
  Synthetic construct
ucugcaacuuguaaguguuua

SEQ ID NO: 3102 - RNA, 21 nt, Artificial Sequence
  Synthetic construct
uauuguaaagcaauauuauaa

SEQ ID NO: 3103 - RNA, 21 nt, Artificial Sequence
  Synthetic construct
auaugcugaacugaaagcaua

SEQ ID NO: 3104 - RNA, 21 nt, Artificial Sequence
  Synthetic construct
aaaucugaauaacauaaagaa

SEQ ID NO: 3105 - RNA, 21 nt, Artificial Sequence
  Synthetic construct
uucaucacccaccaaguagcu

SEQ ID NO: 3106 - RNA, 21 nt, Artificial Sequence
  Synthetic construct
aguagcuacaggauucuguga

SEQ ID NO: 3107 - RNA, 21 nt, Artificial Sequence
  Synthetic construct
acaguuauacagacaacagga

SEQ ID NO: 3108 - RNA, 21 nt, Artificial Sequence
  Synthetic construct
agagguuaagugacuugccua

SEQ ID NO: 3109 - RNA, 21 nt, Artificial Sequence
  Synthetic construct
uagacauuguuuaauauuaaa

SEQ ID NO: 3110 - RNA, 21 nt, Artificial Sequence
  Synthetic construct
ugaacacacauauuccucucc

SEQ ID NO: 3111 - RNA, 21 nt, Artificial Sequence
  Synthetic construct
uucacuucaaaucccaggccc

SEQ ID NO: 3112 - RNA, 21 nt, Artificial Sequence
  Synthetic construct
uauuccaugacuacccauagu

SEQ ID NO: 3113 - RNA, 21 nt, Artificial Sequence
  Synthetic construct
ugggagauacuugcacuacug

SEQ ID NO: 3114 - RNA, 21 nt, Artificial Sequence
  Synthetic construct
aacaaggauuucaguauucua

SEQ ID NO: 3115 - RNA, 21 nt, Artificial Sequence
  Synthetic construct
acaggugugcacauggaggug

SEQ ID NO: 3116 - RNA, 21 nt, Artificial Sequence
  Synthetic construct
uccaaucuaaagcaaccacaa

SEQ ID NO: 3117 - RNA, 21 nt, Artificial Sequence
  Synthetic construct
aauuccaccacccuaacacaa

SEQ ID NO: 3118 - RNA, 21 nt, Artificial Sequence
  Synthetic construct
ucuuggguugcuguugaaggu

SEQ ID NO: 3119 - RNA, 21 nt, Artificial Sequence
  Synthetic construct
aaagucugaaggaagagagau

SEQ ID NO: 3120 - RNA, 21 nt, Artificial Sequence
  Synthetic construct
uauuuacaaugacacacacac

SEQ ID NO: 3121 - RNA, 21 nt, Artificial Sequence
  Synthetic construct
guauucuacauuuaucugguu

SEQ ID NO: 3122 - RNA, 21 nt, Artificial Sequence
  Synthetic construct
uguuacuauucauccucagug

SEQ ID NO: 3123 - RNA, 21 nt, Artificial Sequence
  Synthetic construct
aauaccuuuaauccaaaguua

SEQ ID NO: 3124 - RNA, 21 nt, Artificial Sequence
  Synthetic construct
uaaagaaagugcuuucauuuu

SEQ ID NO: 3125 - RNA, 21 nt, Artificial Sequence
  Synthetic construct
agauaucaacuuucggaccau

SEQ ID NO: 3126 - RNA, 21 nt, Artificial Sequence
  Synthetic construct
aacaaauuaauuugucaacau

SEQ ID NO: 3127 - RNA, 21 nt, Artificial Sequence
  Synthetic construct
ugguuuggagcugugguugag

SEQ ID NO: 3128 - RNA, 21 nt, Artificial Sequence
  Synthetic construct
acacauugaacuugaauuuug

SEQ ID NO: 3129 - RNA, 21 nt, Artificial Sequence
  Synthetic construct
ucaaagauuuggauagacuca

SEQ ID NO: 3130 - RNA, 21 nt, Artificial Sequence
  Synthetic construct
uggaaucauagaauuugagaa

SEQ ID NO: 3131 - RNA, 21 nt, Artificial Sequence
  Synthetic construct
agcacacacauugaacuugaa

SEQ ID NO: 3132 - RNA, 21 nt, Artificial Sequence
  Synthetic construct
uugcagcgauaaucagaggag

SEQ ID NO: 3133 - RNA, 21 nt, Artificial Sequence
  Synthetic construct
auaauuuguaucauaaguaaa

SEQ ID NO: 3134 - RNA, 21 nt, Artificial Sequence
  Synthetic construct
agagggacuacucucuaacuu

SEQ ID NO: 3135 - RNA, 21 nt, Artificial Sequence
  Synthetic construct
cuagcaaauaucucugcccug

SEQ ID NO: 3136 - RNA, 21 nt, Artificial Sequence
  Synthetic construct
aauuucacuacacaugguuua

SEQ ID NO: 3137 - RNA, 21 nt, Artificial Sequence
  Synthetic construct
uucuagcaagugugacagugu

SEQ ID NO: 3138 - RNA, 21 nt, Artificial Sequence
  Synthetic construct
uuuacuuaauguccaacaagg

SEQ ID NO: 3139 - RNA, 21 nt, Artificial Sequence
  Synthetic construct
aaucagaggagucaggcugga

SEQ ID NO: 3140 - RNA, 21 nt, Artificial Sequence
  Synthetic construct
aagcacacacauugaacuuga

SEQ ID NO: 3141 - RNA, 21 nt, Artificial Sequence
  Synthetic construct
uugggauaugauuguaaguua

SEQ ID NO: 3142 - RNA, 21 nt, Artificial Sequence
  Synthetic construct
ucacuucaacauugcugcccu

SEQ ID NO: 3143 - RNA, 21 nt, Artificial Sequence
  Synthetic construct
gaacaucuagaacagcuugug

SEQ ID NO: 3144 - RNA, 21 nt, Artificial Sequence
  Synthetic construct
uagugaaacuaagcagcauau

SEQ ID NO: 3145 - RNA, 21 nt, Artificial Sequence
  Synthetic construct
aaguacaguuauauucuagca

SEQ ID NO: 3146 - RNA, 21 nt, Artificial Sequence
  Synthetic construct
ugaauuucccggcacuaugag

SEQ ID NO: 3147 - RNA, 21 nt, Artificial Sequence
  Synthetic construct
aaguuuggaguaaucgugccc

SEQ ID NO: 3148 - RNA, 21 nt, Artificial Sequence
  Synthetic construct
uaugaguauaaucccaguaga

SEQ ID NO: 3149 - RNA, 21 nt, Artificial Sequence
  Synthetic construct
aacauggacacacaaauauuu

SEQ ID NO: 3150 - RNA, 21 nt, Artificial Sequence
  Synthetic construct
uucuuccuaggcuaguauuua

SEQ ID NO: 3151 - RNA, 21 nt, Artificial Sequence
  Synthetic construct
aagcccuuccugaacacacau

SEQ ID NO: 3152 - RNA, 21 nt, Artificial Sequence
  Synthetic construct
acauuuaugaauaugcuuuug

SEQ ID NO: 3153 - RNA, 21 nt, Artificial Sequence
  Synthetic construct
acugucaguuuacaaaugcug

SEQ ID NO: 3154 - RNA, 21 nt, Artificial Sequence
  Synthetic construct
uauuaugggauagcauuugcc

SEQ ID NO: 3155 - RNA, 21 nt, Artificial Sequence
  Synthetic construct
auuuauuuccuucccagucca

SEQ ID NO: 3156 - RNA, 21 nt, Artificial Sequence
  Synthetic construct
acacacacacgagaucagcaa

SEQ ID NO: 3157 - RNA, 21 nt, Artificial Sequence
  Synthetic construct
uguccaacaaggauuucagua

SEQ ID NO: 3158 - RNA, 21 nt, Artificial Sequence
  Synthetic construct
uguauugagaaugaccaauaa

SEQ ID NO: 3159 - RNA, 21 nt, Artificial Sequence
  Synthetic construct
uuucugguuguugacuguuuc

SEQ ID NO: 3160 - RNA, 21 nt, Artificial Sequence
  Synthetic construct
acacagucacuaauguacuga

SEQ ID NO: 3161 - RNA, 21 nt, Artificial Sequence
  Synthetic construct
uucccgcauuugcagauucag

SEQ ID NO: 3162 - RNA, 21 nt, Artificial Sequence
  Synthetic construct
uucuuacagaguugaauguuu

SEQ ID NO: 3163 - RNA, 21 nt, Artificial Sequence
  Synthetic construct
aaugcuacaaguuguauagaa

SEQ ID NO: 3164 - RNA, 21 nt, Artificial Sequence
  Synthetic construct
aauccuucagcaucacugugg

SEQ ID NO: 3165 - RNA, 21 nt, Artificial Sequence
  Synthetic construct
aguuucacucuuguugccgag

SEQ ID NO: 3166 - RNA, 21 nt, Artificial Sequence
  Synthetic construct
ucaucuucuucuucagacaca

SEQ ID NO: 3167 - RNA, 21 nt, Artificial Sequence
  Synthetic construct
uugcaauacuuuagguccaag

SEQ ID NO: 3168 - RNA, 21 nt, Artificial Sequence
  Synthetic construct
uauguuggucaggcuggucuc

SEQ ID NO: 3169 - RNA, 21 nt, Artificial Sequence
  Synthetic construct
uuuacccucuuuccagcagug

SEQ ID NO: 3170 - RNA, 21 nt, Artificial Sequence
  Synthetic construct
ucuacacagacacuccgcaga

SEQ ID NO: 3171 - RNA, 21 nt, Artificial Sequence
  Synthetic construct
acagcuucuuucuaauacuua

SEQ ID NO: 3172 - RNA, 21 nt, Artificial Sequence
  Synthetic construct
caacuuucggaccauaagcuu

SEQ ID NO: 3173 - RNA, 21 nt, Artificial Sequence
  Synthetic construct
aaagccuauggaauaauugua

SEQ ID NO: 3174 - RNA, 21 nt, Artificial Sequence
  Synthetic construct
augauuucaaagucagcuuuu

SEQ ID NO: 3175 - RNA, 21 nt, Artificial Sequence
  Synthetic construct
uuccuucccaguccacaugca

SEQ ID NO: 3176 - RNA, 21 nt, Artificial Sequence
  Synthetic construct
auguuggucaggcuggucucg

SEQ ID NO: 3177 - RNA, 21 nt, Artificial Sequence
  Synthetic construct
uaucuguccuucauccauaca

SEQ ID NO: 3178 - RNA, 21 nt, Artificial Sequence
  Synthetic construct
uugcaacucuauuagggcaug

SEQ ID NO: 3179 - RNA, 21 nt, Artificial Sequence
  Synthetic construct
augcuaacuaaugaauagggc

SEQ ID NO: 3180 - RNA, 21 nt, Artificial Sequence
  Synthetic construct
uguucuuaauugcuuccuuug

SEQ ID NO: 3181 - RNA, 21 nt, Artificial Sequence
  Synthetic construct
aucugaagggucacugcucca

SEQ ID NO: 3182 - RNA, 21 nt, Artificial Sequence
  Synthetic construct
uacuaaaucuguugaacaugu

SEQ ID NO: 3183 - RNA, 21 nt, Artificial Sequence
  Synthetic construct
acuuauagauaauagucuccu

SEQ ID NO: 3184 - RNA, 21 nt, Artificial Sequence
  Synthetic construct
aucuucuucuucagacacagg

SEQ ID NO: 3185 - RNA, 21 nt, Artificial Sequence
  Synthetic construct
aacuacugcaaacaaccuaua

SEQ ID NO: 3186 - RNA, 21 nt, Artificial Sequence
  Synthetic construct
ucucuauggaucaccugguuu

SEQ ID NO: 3187 - RNA, 21 nt, Artificial Sequence
  Synthetic construct
auuguaccaaaugugaauccu

SEQ ID NO: 3188 - RNA, 21 nt, Artificial Sequence
  Synthetic construct
uucucaaugcuaauagcaugu

SEQ ID NO: 3189 - RNA, 21 nt, Artificial Sequence
  Synthetic construct
auuucuuacagaguugaaugu

SEQ ID NO: 3190 - RNA, 21 nt, Artificial Sequence
  Synthetic construct
uauaucaccuuucucuagauc

SEQ ID NO: 3191 - RNA, 21 nt, Artificial Sequence
  Synthetic construct
aauuaauuugucaacauuucu

SEQ ID NO: 3192 - RNA, 21 nt, Artificial Sequence
  Synthetic construct
uguuuacuuaauguccaacaa

SEQ ID NO: 3193 - RNA, 21 nt, Artificial Sequence
  Synthetic construct
ucaguuacaacuaauuucaca

SEQ ID NO: 3194 - RNA, 21 nt, Artificial Sequence
  Synthetic construct
ucuaauacuuauuagaaauau

SEQ ID NO: 3195 - RNA, 21 nt, Artificial Sequence
  Synthetic construct
acguacacuauauaguuugcu

SEQ ID NO: 3196 - RNA, 21 nt, Artificial Sequence
  Synthetic construct
ugcaacagauguuaucaaggg

SEQ ID NO: 3197 - RNA, 21 nt, Artificial Sequence
  Synthetic construct
uucuggagcucuggaguucca

SEQ ID NO: 3198 - RNA, 21 nt, Artificial Sequence
  Synthetic construct
uuacaugaauacaaauuuaua

SEQ ID NO: 3199 - RNA, 21 nt, Artificial Sequence
  Synthetic construct
uuauggucacuucaacauugc

SEQ ID NO: 3200 - RNA, 21 nt, Artificial Sequence
  Synthetic construct
aagucauauaaggaauucugu

SEQ ID NO: 3201 - RNA, 21 nt, Artificial Sequence
  Synthetic construct
uaacugcaaguagcuuagaua

SEQ ID NO: 3202 - RNA, 21 nt, Artificial Sequence
  Synthetic construct
acaguuauauucuagcaagug

SEQ ID NO: 3203 - RNA, 21 nt, Artificial Sequence
  Synthetic construct
aagugguuuggagcugugguu

SEQ ID NO: 3204 - RNA, 21 nt, Artificial Sequence
  Synthetic construct
ucugaggugacuaccucauua

SEQ ID NO: 3205 - RNA, 21 nt, Artificial Sequence
  Synthetic construct
aacacucacaaugcuucuuag

SEQ ID NO: 3206 - RNA, 21 nt, Artificial Sequence
  Synthetic construct
uauaacaauaucaaauaaaau

SEQ ID NO: 3207 - RNA, 21 nt, Artificial Sequence
  Synthetic construct
acacacauugaacuugaauuu

SEQ ID NO: 3208 - RNA, 21 nt, Artificial Sequence
  Synthetic construct
aauagcauguaauuacuuuuu

SEQ ID NO: 3209 - RNA, 21 nt, Artificial Sequence
  Synthetic construct
uuauuaucaaaucuugguaca

SEQ ID NO: 3210 - RNA, 21 nt, Artificial Sequence
  Synthetic construct
aaagaauaaauacuugaguua

SEQ ID NO: 3211 - RNA, 21 nt, Artificial Sequence
  Synthetic construct
cugaauuucaguccucuuguu

SEQ ID NO: 3212 - RNA, 21 nt, Artificial Sequence
  Synthetic construct
augaacuucauuugcuugagu

SEQ ID NO: 3213 - RNA, 21 nt, Artificial Sequence
  Synthetic construct
acauccaucucaagacagcga

SEQ ID NO: 3214 - RNA, 21 nt, Artificial Sequence
  Synthetic construct
uauuugguacugcuggugaag

SEQ ID NO: 3215 - RNA, 21 nt, Artificial Sequence
  Synthetic construct
aggauuucauugaauuucccg

SEQ ID NO: 3216 - RNA, 21 nt, Artificial Sequence
  Synthetic construct
uuagauaaagaccaagagauu

SEQ ID NO: 3217 - RNA, 21 nt, Artificial Sequence
  Synthetic construct
aagagaccagauaucaacuuu

SEQ ID NO: 3218 - RNA, 21 nt, Artificial Sequence
  Synthetic construct
aucaucuuacauaguucuuuu

SEQ ID NO: 3219 - RNA, 21 nt, Artificial Sequence
  Synthetic construct
auaacacaaauuguuaguuuu

SEQ ID NO: 3220 - RNA, 21 nt, Artificial Sequence
  Synthetic construct
cacuucaacauugcugcccug

SEQ ID NO: 3221 - RNA, 21 nt, Artificial Sequence
  Synthetic construct
agacaguccuacauauuuguu

SEQ ID NO: 3222 - RNA, 21 nt, Artificial Sequence
  Synthetic construct
uagugcuguauaaacaguacc

SEQ ID NO: 3223 - RNA, 21 nt, Artificial Sequence
  Synthetic construct
uauacugcaaauuaagaagcc

SEQ ID NO: 3224 - RNA, 21 nt, Artificial Sequence
  Synthetic construct
auuuagguaucauuaucuuug

SEQ ID NO: 3225 - RNA, 21 nt, Artificial Sequence
  Synthetic construct
aaacagaaauaggugauacau

SEQ ID NO: 3226 - RNA, 21 nt, Artificial Sequence
  Synthetic construct
ucuucuuccucuucaucuucu

SEQ ID NO: 3227 - RNA, 21 nt, Artificial Sequence
  Synthetic construct
ucauuucucucugcaacuugu

SEQ ID NO: 3228 - RNA, 21 nt, Artificial Sequence
  Synthetic construct
aauaauuguaacuagcaaaua

SEQ ID NO: 3229 - RNA, 21 nt, Artificial Sequence
  Synthetic construct
aacuucauuugcuugaguuuu

SEQ ID NO: 3230 - RNA, 21 nt, Artificial Sequence
  Synthetic construct
uguucacacaguacuugcucu

SEQ ID NO: 3231 - RNA, 21 nt, Artificial Sequence
  Synthetic construct
uauccagaccgucagacauuu

SEQ ID NO: 3232 - RNA, 21 nt, Artificial Sequence
  Synthetic construct
aaagcucauguauuucugguu

SEQ ID NO: 3233 - RNA, 21 nt, Artificial Sequence
  Synthetic construct
ucacggaauacagcugacagu

SEQ ID NO: 3234 - RNA, 21 nt, Artificial Sequence
  Synthetic construct
uggaaccauaccaucagcagg

SEQ ID NO: 3235 - RNA, 21 nt, Artificial Sequence
  Synthetic construct
uuggaaucauagaauuugaga

SEQ ID NO: 3236 - RNA, 21 nt, Artificial Sequence
  Synthetic construct
uaaacacguacacuauauagu

SEQ ID NO: 3237 - RNA, 21 nt, Artificial Sequence
  Synthetic construct
cacaacacuaugaagagggag

SEQ ID NO: 3238 - RNA, 21 nt, Artificial Sequence
  Synthetic construct
cacacuagcaacaucaaagau

SEQ ID NO: 3239 - RNA, 21 nt, Artificial Sequence
  Synthetic construct
uccaucuuuccugcagcagag

SEQ ID NO: 3240 - RNA, 21 nt, Artificial Sequence
  Synthetic construct
auauaaggaauucugucggac

SEQ ID NO: 3241 - RNA, 21 nt, Artificial Sequence
  Synthetic construct
caacauuaacguucuuuccuu

SEQ ID NO: 3242 - RNA, 21 nt, Artificial Sequence
  Synthetic construct
uggugugaccucuuuauuugg

SEQ ID NO: 3243 - RNA, 21 nt, Artificial Sequence
  Synthetic construct
auaaagaauaaauacuugagu

SEQ ID NO: 3244 - RNA, 21 nt, Artificial Sequence
  Synthetic construct
uauacauaacucuccaauaca

SEQ ID NO: 3245 - RNA, 21 nt, Artificial Sequence
  Synthetic construct
uguuggguuauauucauuugg

SEQ ID NO: 3246 - RNA, 21 nt, Artificial Sequence
  Synthetic construct
uccuaugaggauuuccuaggu

SEQ ID NO: 3247 - RNA, 21 nt, Artificial Sequence
  Synthetic construct
uucuaaaggagacuccgaugg

SEQ ID NO: 3248 - RNA, 21 nt, Artificial Sequence
  Synthetic construct
uccugauguaaagcucaugua

SEQ ID NO: 3249 - RNA, 21 nt, Artificial Sequence
  Synthetic construct
auuucauugaauuucccggca

SEQ ID NO: 3250 - RNA, 21 nt, Artificial Sequence
  Synthetic construct
aaucucuacugugcuucucac

SEQ ID NO: 3251 - RNA, 21 nt, Artificial Sequence
  Synthetic construct
aucuguccuucauccauacag

SEQ ID NO: 3252 - RNA, 21 nt, Artificial Sequence
  Synthetic construct
aucuccugauguaaagcucau

SEQ ID NO: 3253 - RNA, 21 nt, Artificial Sequence
  Synthetic construct
uccagcaguguacucaucaua

SEQ ID NO: 3254 - RNA, 21 nt, Artificial Sequence
  Synthetic construct
ugcaugggcucugcuaucuug

SEQ ID NO: 3255 - RNA, 21 nt, Artificial Sequence
  Synthetic construct
aaugcuaucuuugguucccaa

SEQ ID NO: 3256 - RNA, 21 nt, Artificial Sequence
  Synthetic construct
augcugaauuucaguccucuu

SEQ ID NO: 3257 - RNA, 21 nt, Artificial Sequence
  Synthetic construct
ucuccugauguaaagcucaug

SEQ ID NO: 3258 - RNA, 21 nt, Artificial Sequence
  Synthetic construct
uacccauaguucaucacccac

SEQ ID NO: 3259 - RNA, 21 nt, Artificial Sequence
  Synthetic construct
uacauauuuguuuaaugauuu

SEQ ID NO: 3260 - RNA, 21 nt, Artificial Sequence
  Synthetic construct
auggaaugugcuucaccgggg

SEQ ID NO: 3261 - RNA, 21 nt, Artificial Sequence
  Synthetic construct
ucugccuacagugaucugaag

SEQ ID NO: 3262 - RNA, 21 nt, Artificial Sequence
  Synthetic construct
caagucauaacuucuauugaa

SEQ ID NO: 3263 - RNA, 21 nt, Artificial Sequence
  Synthetic construct
cuuucuuauucuucucuucag

SEQ ID NO: 3264 - RNA, 21 nt, Artificial Sequence
  Synthetic construct
acacacaagcacacacauuga

SEQ ID NO: 3265 - RNA, 21 nt, Artificial Sequence
  Synthetic construct
ugcaaauuaagaagccuucua

SEQ ID NO: 3266 - RNA, 21 nt, Artificial Sequence
  Synthetic construct
ucauuaucuuuguuuacuuaa

SEQ ID NO: 3267 - RNA, 21 nt, Artificial Sequence
  Synthetic construct
aaucugaauaacauaaagaau

SEQ ID NO: 3268 - RNA, 21 nt, Artificial Sequence
  Synthetic construct
uaaaugugguuucuccuauga

SEQ ID NO: 3269 - RNA, 21 nt, Artificial Sequence
  Synthetic construct
uccucuuucagguauuaagga

SEQ ID NO: 3270 - RNA, 21 nt, Artificial Sequence
  Synthetic construct
aacacuaugaagagggagugu

SEQ ID NO: 3271 - RNA, 21 nt, Artificial Sequence
  Synthetic construct
uaauauuaccguuucauuuuc

SEQ ID NO: 3272 - RNA, 21 nt, Artificial Sequence
  Synthetic construct
ucaucagaaaugcuaucuuug

SEQ ID NO: 3273 - RNA, 21 nt, Artificial Sequence
  Synthetic construct
uuauuuccaaguucccauuua

SEQ ID NO: 3274 - RNA, 21 nt, Artificial Sequence
  Synthetic construct
uauccuucuaguccuccaaaa

SEQ ID NO: 3275 - RNA, 21 nt, Artificial Sequence
  Synthetic construct
uucccaacaaauuaauuuguc

SEQ ID NO: 3276 - RNA, 21 nt, Artificial Sequence
  Synthetic construct
auccucgccuauccacaucca

SEQ ID NO: 3277 - RNA, 21 nt, Artificial Sequence
  Synthetic construct
uuauaucucuauggaucaccu

SEQ ID NO: 3278 - RNA, 21 nt, Artificial Sequence
  Synthetic construct
cuuuguuuacuuaauguccaa

SEQ ID NO: 3279 - RNA, 21 nt, Artificial Sequence
  Synthetic construct
auugaaagaugugcccucguu

SEQ ID NO: 3280 - RNA, 21 nt, Artificial Sequence
  Synthetic construct
uauuccuaacucaggacauuu

SEQ ID NO: 3281 - RNA, 21 nt, Artificial Sequence
  Synthetic construct
cuucucuagguauagggucug

SEQ ID NO: 3282 - RNA, 21 nt, Artificial Sequence
  Synthetic construct
ucaccuuucucuagaucuuua

SEQ ID NO: 3283 - RNA, 21 nt, Artificial Sequence
  Synthetic construct
aacuuauagauaauagucucc

SEQ ID NO: 3284 - RNA, 21 nt, Artificial Sequence
  Synthetic construct
uggacacacaaauauuuacaa

SEQ ID NO: 3285 - RNA, 21 nt, Artificial Sequence
  Synthetic construct
uucuucagacacaggaggggc

SEQ ID NO: 3286 - RNA, 21 nt, Artificial Sequence
  Synthetic construct
ucucgaacuccugaccucagg

SEQ ID NO: 3287 - RNA, 21 nt, Artificial Sequence
  Synthetic construct
uugcaaguucaacccaauuaa

SEQ ID NO: 3288 - RNA, 21 nt, Artificial Sequence
  Synthetic construct
ugugaagaucuuaucaucaau

SEQ ID NO: 3289 - RNA, 21 nt, Artificial Sequence
  Synthetic construct
ucauuauuaaaguucucaccu

SEQ ID NO: 3290 - RNA, 21 nt, Artificial Sequence
  Synthetic construct
auuaugggauagcauuugccu

SEQ ID NO: 3291 - RNA, 21 nt, Artificial Sequence
  Synthetic construct
aaauacacguucagaauugug

SEQ ID NO: 3292 - RNA, 21 nt, Artificial Sequence
  Synthetic construct
agcuuguggguucuucuucug

SEQ ID NO: 3293 - RNA, 21 nt, Artificial Sequence
  Synthetic construct
uauuuacacgaucuuugagcu

SEQ ID NO: 3294 - RNA, 21 nt, Artificial Sequence
  Synthetic construct
ugaauuucaguccucuuguuc

SEQ ID NO: 3295 - RNA, 21 nt, Artificial Sequence
  Synthetic construct
ucucugugaccacaucaguca

SEQ ID NO: 3296 - RNA, 21 nt, Artificial Sequence
  Synthetic construct
uaaaugaauuggaaggcugcc

SEQ ID NO: 3297 - RNA, 21 nt, Artificial Sequence
  Synthetic construct
ucagauacaaugcccugagug

SEQ ID NO: 3298 - RNA, 21 nt, Artificial Sequence
  Synthetic construct
caagcacacacauugaacuug

SEQ ID NO: 3299 - RNA, 21 nt, Artificial Sequence
  Synthetic construct
ugcuguugaagguucaucugc

SEQ ID NO: 3300 - RNA, 21 nt, Artificial Sequence
  Synthetic construct
uucccaccauagugcuucguu

SEQ ID NO: 3301 - RNA, 21 nt, Artificial Sequence
  Synthetic construct
uguuauguuggaaguuuggag

SEQ ID NO: 3302 - RNA, 21 nt, Artificial Sequence
  Synthetic construct
auuauccagaccgucagacau

SEQ ID NO: 3303 - RNA, 21 nt, Artificial Sequence
  Synthetic construct
uugaauguuuacuauaucacc

SEQ ID NO: 3304 - RNA, 21 nt, Artificial Sequence
  Synthetic construct
augaauagggcuuccuaacca

SEQ ID NO: 3305 - RNA, 21 nt, Artificial Sequence
  Synthetic construct
agcaacaucaaagauuuggau

SEQ ID NO: 3306 - RNA, 21 nt, Artificial Sequence
  Synthetic construct
ugaaauuagugggacuugccc

SEQ ID NO: 3307 - RNA, 21 nt, Artificial Sequence
  Synthetic construct
uaaccagguauugggcucucu

SEQ ID NO: 3308 - RNA, 21 nt, Artificial Sequence
  Synthetic construct
ucaauaaugaauaugguauuu

SEQ ID NO: 3309 - RNA, 21 nt, Artificial Sequence
  Synthetic construct
aagaaguuucuauucauuuga

SEQ ID NO: 3310 - RNA, 21 nt, Artificial Sequence
  Synthetic construct
uggagacgaaguuucacucuu

SEQ ID NO: 3311 - RNA, 21 nt, Artificial Sequence
  Synthetic construct
caacauaagagacucaggcuu

SEQ ID NO: 3312 - RNA, 21 nt, Artificial Sequence
  Synthetic construct
uaaauaauuuguaucauaagu

SEQ ID NO: 3313 - RNA, 21 nt, Artificial Sequence
  Synthetic construct
uaauauccuguuggacaagaa

SEQ ID NO: 3314 - RNA, 21 nt, Artificial Sequence
  Synthetic construct
gaauccuucagcaucacugug

SEQ ID NO: 3315 - RNA, 21 nt, Artificial Sequence
  Synthetic construct
ugcagauucaguuagacauug

SEQ ID NO: 3316 - RNA, 21 nt, Artificial Sequence
  Synthetic construct
uauuauagaaucucucagaac

SEQ ID NO: 3317 - RNA, 21 nt, Artificial Sequence
  Synthetic construct
auugggaccauccacuaacuc

SEQ ID NO: 3318 - RNA, 21 nt, Artificial Sequence
  Synthetic construct
aaauauuccauuauuuccaag

SEQ ID NO: 3319 - RNA, 21 nt, Artificial Sequence
  Synthetic construct
agaaauaggugauacauagga

SEQ ID NO: 3320 - RNA, 21 nt, Artificial Sequence
  Synthetic construct
ucuauugcuucaaccacaauu

SEQ ID NO: 3321 - RNA, 21 nt, Artificial Sequence
  Synthetic construct
uuuauuuauuguaaagcaaua

SEQ ID NO: 3322 - RNA, 21 nt, Artificial Sequence
  Synthetic construct
uuuaauccaaaguuacagaag

SEQ ID NO: 3323 - RNA, 21 nt, Artificial Sequence
  Synthetic construct
caaguuacucgauuguaccaa

SEQ ID NO: 3324 - RNA, 21 nt, Artificial Sequence
  Synthetic construct
auaagcacaagagaggauuaa

SEQ ID NO: 3325 - RNA, 21 nt, Artificial Sequence
  Synthetic construct
ucagccucccaaguagcuggg

SEQ ID NO: 3326 - RNA, 21 nt, Artificial Sequence
  Synthetic construct
auuucucaaugcuaauagcau

SEQ ID NO: 3327 - RNA, 21 nt, Artificial Sequence
  Synthetic construct
aagacccuaaggaucaucuag

SEQ ID NO: 3328 - RNA, 21 nt, Artificial Sequence
  Synthetic construct
gagaagaauauugucacucuu

SEQ ID NO: 3329 - RNA, 21 nt, Artificial Sequence
  Synthetic construct
ucuauaacacaaauuguuagu

SEQ ID NO: 3330 - RNA, 21 nt, Artificial Sequence
  Synthetic construct
ucacugcuccaaggucuccaa

SEQ ID NO: 3331 - RNA, 21 nt, Artificial Sequence
  Synthetic construct
auuuggucacuuaaaggagug

SEQ ID NO: 3332 - RNA, 21 nt, Artificial Sequence
  Synthetic construct
uccuucauccauacaggucuc

SEQ ID NO: 3333 - RNA, 21 nt, Artificial Sequence
  Synthetic construct
cuacaucugacucauucucua

SEQ ID NO: 3334 - RNA, 21 nt, Artificial Sequence
  Synthetic construct
ucuuccaucuuuccugcagca

SEQ ID NO: 3335 - RNA, 21 nt, Artificial Sequence
  Synthetic construct
acugcaacauaagagacucag

SEQ ID NO: 3336 - RNA, 21 nt, Artificial Sequence
  Synthetic construct
aagcaauggauucaaccacag

SEQ ID NO: 3337 - RNA, 21 nt, Artificial Sequence
  Synthetic construct
cucugugaccacaucagucag

SEQ ID NO: 3338 - RNA, 21 nt, Artificial Sequence
  Synthetic construct
aucccgguuguuacuauucau

SEQ ID NO: 3339 - RNA, 21 nt, Artificial Sequence
  Synthetic construct
agaagauucaggaagugccaa

SEQ ID NO: 3340 - RNA, 21 nt, Artificial Sequence
  Synthetic construct
aagcccagcacuacuucacag

SEQ ID NO: 3341 - RNA, 21 nt, Artificial Sequence
  Synthetic construct
aaaugugguuucuccuaugag

SEQ ID NO: 3342 - RNA, 21 nt, Artificial Sequence
  Synthetic construct
aucuaaauaauuaacaauauu

SEQ ID NO: 3343 - RNA, 21 nt, Artificial Sequence
  Synthetic construct
uaucucugcccugcaugcucu

SEQ ID NO: 3344 - RNA, 21 nt, Artificial Sequence
  Synthetic construct
auuaaacacauucccaaugca

SEQ ID NO: 3345 - RNA, 21 nt, Artificial Sequence
  Synthetic construct
uaguaugcuucaaauuaauau

SEQ ID NO: 3346 - RNA, 21 nt, Artificial Sequence
  Synthetic construct
uccuaagaaagcgugugccau

SEQ ID NO: 3347 - RNA, 21 nt, Artificial Sequence
  Synthetic construct
agaaggauggaaccauaccau

SEQ ID NO: 3348 - RNA, 21 nt, Artificial Sequence
  Synthetic construct
uuagggcauggacuuccacau

SEQ ID NO: 3349 - RNA, 21 nt, Artificial Sequence
  Synthetic construct
aaacucuagaaagcccagcac

SEQ ID NO: 3350 - RNA, 21 nt, Artificial Sequence
  Synthetic construct
aacauggugacugauuugagg

SEQ ID NO: 3351 - RNA, 21 nt, Artificial Sequence
  Synthetic construct
aaauaauuuguaucauaagua

SEQ ID NO: 3352 - RNA, 21 nt, Artificial Sequence
  Synthetic construct
cuuaacugaauauuaacugca

SEQ ID NO: 3353 - RNA, 21 nt, Artificial Sequence
  Synthetic construct
agaaauaaacccauugagcaa

SEQ ID NO: 3354 - RNA, 21 nt, Artificial Sequence
  Synthetic construct
uagaaagcccagcacuacuuc

SEQ ID NO: 3355 - RNA, 21 nt, Artificial Sequence
  Synthetic construct
uccuguugcaaugucuagugc

SEQ ID NO: 3356 - RNA, 21 nt, Artificial Sequence
  Synthetic construct
aagaagccuucuauaacacaa

SEQ ID NO: 3357 - RNA, 21 nt, Artificial Sequence
  Synthetic construct
cacauguucacacaguacuug

SEQ ID NO: 3358 - RNA, 21 nt, Artificial Sequence
  Synthetic construct
cauuauuaaaguucucaccua

SEQ ID NO: 3359 - RNA, 21 nt, Artificial Sequence
  Synthetic construct
uuguuacuauucauccucagu

SEQ ID NO: 3360 - RNA, 21 nt, Artificial Sequence
  Synthetic construct
ugggaagauagagcgaagccu

SEQ ID NO: 3361 - RNA, 21 nt, Artificial Sequence
  Synthetic construct
agaauacucguacacacaggu

SEQ ID NO: 3362 - RNA, 21 nt, Artificial Sequence
  Synthetic construct
ucuuccucuucaucuucuucu

SEQ ID NO: 3363 - RNA, 21 nt, Artificial Sequence
  Synthetic construct
ucaugcacaauccauauuuca

SEQ ID NO: 3364 - RNA, 21 nt, Artificial Sequence
  Synthetic construct
aacuagcaaauaucucugccc

SEQ ID NO: 3365 - RNA, 21 nt, Artificial Sequence
  Synthetic construct
uuucucuucauuauccagacc

SEQ ID NO: 3366 - RNA, 21 nt, Artificial Sequence
  Synthetic construct
aaugcuaauagcauguaauua

SEQ ID NO: 3367 - RNA, 21 nt, Artificial Sequence
  Synthetic construct
ucagagcucagagacugggag

SEQ ID NO: 3368 - RNA, 21 nt, Artificial Sequence
  Synthetic construct
uuuggaguucuaauagugaca

SEQ ID NO: 3369 - RNA, 21 nt, Artificial Sequence
  Synthetic construct
ucacugaccucccauuucuua

SEQ ID NO: 3370 - RNA, 21 nt, Artificial Sequence
  Synthetic construct
uaauguccaacaaggauuuca

SEQ ID NO: 3371 - RNA, 21 nt, Artificial Sequence
  Synthetic construct
uccuucuucuuauugguuuua

SEQ ID NO: 3372 - RNA, 21 nt, Artificial Sequence
  Synthetic construct
ugcaagucauaacuucuauug

SEQ ID NO: 3373 - RNA, 21 nt, Artificial Sequence
  Synthetic construct
uaagauguggauauauggaug

SEQ ID NO: 3374 - RNA, 21 nt, Artificial Sequence
  Synthetic construct
acguggauccuucucaacuug

SEQ ID NO: 3375 - RNA, 21 nt, Artificial Sequence
  Synthetic construct
aauacuugaguuaaaucuucu

SEQ ID NO: 3376 - RNA, 21 nt, Artificial Sequence
  Synthetic construct
aguguacucaucauacaacug

SEQ ID NO: 3377 - RNA, 21 nt, Artificial Sequence
  Synthetic construct
ucucaggauucuggagcucug

SEQ ID NO: 3378 - RNA, 21 nt, Artificial Sequence
  Synthetic construct
uccuaccugaaugauauacag

SEQ ID NO: 3379 - RNA, 21 nt, Artificial Sequence
  Synthetic construct
auagggcuuccuaaccaggua

SEQ ID NO: 3380 - RNA, 21 nt, Artificial Sequence
  Synthetic construct
auauauggugaaauaguaguc

SEQ ID NO: 3381 - RNA, 21 nt, Artificial Sequence
  Synthetic construct
agugauauuauagaaucucuc

SEQ ID NO: 3382 - RNA, 21 nt, Artificial Sequence
  Synthetic construct
auguaucuauuuccuccuggu

SEQ ID NO: 3383 - RNA, 21 nt, Artificial Sequence
  Synthetic construct
aaagucagucaauuuaacaga

SEQ ID NO: 3384 - RNA, 21 nt, Artificial Sequence
  Synthetic construct
uuugggcugcgauucaggcuu

SEQ ID NO: 3385 - RNA, 21 nt, Artificial Sequence
  Synthetic construct
ucuuuguccauaugcauuucu

SEQ ID NO: 3386 - RNA, 21 nt, Artificial Sequence
  Synthetic construct
uuugaaugcaagagggacuac

SEQ ID NO: 3387 - RNA, 21 nt, Artificial Sequence
  Synthetic construct
auuuauuguaaagcaauauua

SEQ ID NO: 3388 - RNA, 21 nt, Artificial Sequence
  Synthetic construct
uuucugcuguuuauuuauugu

SEQ ID NO: 3389 - RNA, 21 nt, Artificial Sequence
  Synthetic construct
aauaucucugcccugcaugcu

SEQ ID NO: 3390 - RNA, 21 nt, Artificial Sequence
  Synthetic construct
uuuguuuacuuaauguccaac

SEQ ID NO: 3391 - RNA, 21 nt, Artificial Sequence
  Synthetic construct
auaugguauuugcggguccau

SEQ ID NO: 3392 - RNA, 21 nt, Artificial Sequence
  Synthetic construct
auuauuaucaaaucuugguac

SEQ ID NO: 3393 - RNA, 21 nt, Artificial Sequence
  Synthetic construct
uaaaugcuacaaguuguauag

SEQ ID NO: 3394 - RNA, 21 nt, Artificial Sequence
  Synthetic construct
auaguuugcugaaacucuaaa

SEQ ID NO: 3395 - RNA, 21 nt, Artificial Sequence
  Synthetic construct
ugcuaacuaaugaauagggcu

SEQ ID NO: 3396 - RNA, 21 nt, Artificial Sequence
  Synthetic construct
uuccagaaaggcaauaucugc

SEQ ID NO: 3397 - RNA, 21 nt, Artificial Sequence
  Synthetic construct
agaaccugaacucaccuagca

SEQ ID NO: 3398 - RNA, 21 nt, Artificial Sequence
  Synthetic construct
ugaugauuaauguaucuauuu

SEQ ID NO: 3399 - RNA, 21 nt, Artificial Sequence
  Synthetic construct
uccgaaacagaaauaggugau

SEQ ID NO: 3400 - RNA, 21 nt, Artificial Sequence
  Synthetic construct
uugucaucagaaaugcuaucu

SEQ ID NO: 3401 - RNA, 21 nt, Artificial Sequence
  Synthetic construct
uuugaaagguaaagaaccccc

SEQ ID NO: 3402 - RNA, 21 nt, Artificial Sequence
  Synthetic construct
cuuagagaaacaacuuucugu

SEQ ID NO: 3403 - RNA, 21 nt, Artificial Sequence
  Synthetic construct
auaucauuuauagacaaauau

SEQ ID NO: 3404 - RNA, 21 nt, Artificial Sequence
  Synthetic construct
aggauuucaccguuugagcuu

SEQ ID NO: 3405 - RNA, 21 nt, Artificial Sequence
  Synthetic construct
uagugggacuugcccuauugg

SEQ ID NO: 3406 - RNA, 21 nt, Artificial Sequence
  Synthetic construct
auauuuguuuaaugauuucaa

SEQ ID NO: 3407 - RNA, 21 nt, Artificial Sequence
  Synthetic construct
ucacauagcaauuuaguaaua

SEQ ID NO: 3408 - RNA, 21 nt, Artificial Sequence
  Synthetic construct
gaauacucguacacacaggug

SEQ ID NO: 3409 - RNA, 21 nt, Artificial Sequence
  Synthetic construct
uuccacauguucacacaguac

SEQ ID NO: 3410 - RNA, 21 nt, Artificial Sequence
  Synthetic construct
aaccugaacucaccuagcagg

SEQ ID NO: 3411 - RNA, 21 nt, Artificial Sequence
  Synthetic construct
ucuuacagaguugaauguuua

SEQ ID NO: 3412 - RNA, 21 nt, Artificial Sequence
  Synthetic construct
uacuucacaggaaaggagaag

SEQ ID NO: 3413 - RNA, 21 nt, Artificial Sequence
  Synthetic construct
caacuuguaaguguuuagguu

SEQ ID NO: 3414 - RNA, 21 nt, Artificial Sequence
  Synthetic construct
gcuaacaacauuaacguucuu

SEQ ID NO: 3415 - RNA, 21 nt, Artificial Sequence
  Synthetic construct
auucaguuagacauuguuuaa

SEQ ID NO: 3416 - RNA, 21 nt, Artificial Sequence
  Synthetic construct
uacaaagugguaguaaagaag

SEQ ID NO: 3417 - RNA, 21 nt, Artificial Sequence
  Synthetic construct
uacauaaguucuguuuagauu

SEQ ID NO: 3418 - RNA, 21 nt, Artificial Sequence
  Synthetic construct
aaauauacauaacucuccaau

SEQ ID NO: 3419 - RNA, 21 nt, Artificial Sequence
  Synthetic construct
uguccuucauccauacagguc

SEQ ID NO: 3420 - RNA, 21 nt, Artificial Sequence
  Synthetic construct
augcucuggucuuggugcgau

SEQ ID NO: 3421 - RNA, 21 nt, Artificial Sequence
  Synthetic construct
aguauucuacauuuaucuggu

SEQ ID NO: 3422 - RNA, 21 nt, Artificial Sequence
  Synthetic construct
auaaacaguaccugaugcccc

SEQ ID NO: 3423 - RNA, 21 nt, Artificial Sequence
  Synthetic construct
ucaucuccugaacauaaacac

SEQ ID NO: 3424 - RNA, 21 nt, Artificial Sequence
  Synthetic construct
uaguauuuaucccacuacauc

SEQ ID NO: 3425 - RNA, 21 nt, Artificial Sequence
  Synthetic construct
aucccacuacaucugacucau

SEQ ID NO: 3426 - RNA, 21 nt, Artificial Sequence
  Synthetic construct
cauagaauuugagaacaucua

SEQ ID NO: 3427 - RNA, 21 nt, Artificial Sequence
  Synthetic construct
uacacacaggugugcacaugg

SEQ ID NO: 3428 - RNA, 21 nt, Artificial Sequence
  Synthetic construct
aacgaagucauuacccaacau

SEQ ID NO: 3429 - RNA, 21 nt, Artificial Sequence
  Synthetic construct
uugagugcaggaaauccaaag

SEQ ID NO: 3430 - RNA, 21 nt, Artificial Sequence
  Synthetic construct
uaggcagggcauugggaccau

SEQ ID NO: 3431 - RNA, 21 nt, Artificial Sequence
  Synthetic construct
augugaauccuucagcaucac

SEQ ID NO: 3432 - RNA, 21 nt, Artificial Sequence
  Synthetic construct
acacacaggugugcacaugga

SEQ ID NO: 3433 - RNA, 21 nt, Artificial Sequence
  Synthetic construct
ucauaggagaaauauuccauu

SEQ ID NO: 3434 - RNA, 21 nt, Artificial Sequence
  Synthetic construct
ucugcuguuuauuuauuguaa

SEQ ID NO: 3435 - RNA, 21 nt, Artificial Sequence
  Synthetic construct
cuucaaauuaauauuaccguu

SEQ ID NO: 3436 - RNA, 21 nt, Artificial Sequence
  Synthetic construct
ucucugggcgcucuuucuccu

SEQ ID NO: 3437 - RNA, 21 nt, Artificial Sequence
  Synthetic construct
uccuaggcuaguauuuauccc

SEQ ID NO: 3438 - RNA, 21 nt, Artificial Sequence
  Synthetic construct
uuucucugccuacagugaucu

SEQ ID NO: 3439 - RNA, 21 nt, Artificial Sequence
  Synthetic construct
caacauugaaagaugugcccu

SEQ ID NO: 3440 - RNA, 21 nt, Artificial Sequence
  Synthetic construct
uucuuagcuucucuaagaucu

SEQ ID NO: 3441 - RNA, 21 nt, Artificial Sequence
  Synthetic construct
acagucucucaggauucugga

SEQ ID NO: 3442 - RNA, 21 nt, Artificial Sequence
  Synthetic construct
ugguuuacucaauuaucuuuu

SEQ ID NO: 3443 - RNA, 21 nt, Artificial Sequence
  Synthetic construct
aguucuaauagugacaucucc

SEQ ID NO: 3444 - RNA, 21 nt, Artificial Sequence
  Synthetic construct
accacacacaagcacacacau

SEQ ID NO: 3445 - RNA, 21 nt, Artificial Sequence
  Synthetic construct
ucucuauguuggucaggcugg

SEQ ID NO: 3446 - RNA, 21 nt, Artificial Sequence
  Synthetic construct
ucaaagucugaaggaagagag

SEQ ID NO: 3447 - RNA, 21 nt, Artificial Sequence
  Synthetic construct
agaccaagagauucaaccggg

SEQ ID NO: 3448 - RNA, 21 nt, Artificial Sequence
  Synthetic construct
uucaccuuccaccauuucaau

SEQ ID NO: 3449 - RNA, 21 nt, Artificial Sequence
  Synthetic construct
caaaguauaacauaguaugcu

SEQ ID NO: 3450 - RNA, 21 nt, Artificial Sequence
  Synthetic construct
uagcuacaggauucugugaag

SEQ ID NO: 3451 - RNA, 21 nt, Artificial Sequence
  Synthetic construct
aauaucugcaacagauguuau

SEQ ID NO: 3452 - RNA, 21 nt, Artificial Sequence
  Synthetic construct
acaaugacacacacacgagau

SEQ ID NO: 3453 - RNA, 21 nt, Artificial Sequence
  Synthetic construct
aaguuucacucuuguugccga

SEQ ID NO: 3454 - RNA, 21 nt, Artificial Sequence
  Synthetic construct
aacauugaaagaugugcccuc

SEQ ID NO: 3455 - RNA, 21 nt, Artificial Sequence
  Synthetic construct
ucugcaacagauguuaucaag

SEQ ID NO: 3456 - RNA, 21 nt, Artificial Sequence
  Synthetic construct
gugguaguaaagaaguaccug

SEQ ID NO: 3457 - RNA, 21 nt, Artificial Sequence
  Synthetic construct
augcuucuuagcuucucuaag

SEQ ID NO: 3458 - RNA, 21 nt, Artificial Sequence
  Synthetic construct
ugcugaagaaucccgguuguu

SEQ ID NO: 3459 - RNA, 21 nt, Artificial Sequence
  Synthetic construct
acuacaucugacucauucucu

SEQ ID NO: 3460 - RNA, 21 nt, Artificial Sequence
  Synthetic construct
uucgcuucacgguggaaguga

SEQ ID NO: 3461 - RNA, 21 nt, Artificial Sequence
  Synthetic construct
aagcucauguauuucugguug

SEQ ID NO: 3462 - RNA, 21 nt, Artificial Sequence
  Synthetic construct
ucuccucaucugucaucuugg

SEQ ID NO: 3463 - RNA, 21 nt, Artificial Sequence
  Synthetic construct
auuacauaaucugagggagua

SEQ ID NO: 3464 - RNA, 21 nt, Artificial Sequence
  Synthetic construct
auucucuacuaucgcuguuga

SEQ ID NO: 3465 - RNA, 21 nt, Artificial Sequence
  Synthetic construct
aucacauuggguaaggaguuu

SEQ ID NO: 3466 - RNA, 21 nt, Artificial Sequence
  Synthetic construct
uuucuuuggugaguuagaagg

SEQ ID NO: 3467 - RNA, 21 nt, Artificial Sequence
  Synthetic construct
caauuuaguaauaaagcucau

SEQ ID NO: 3468 - RNA, 21 nt, Artificial Sequence
  Synthetic construct
auugcugcccuguuugggcug

SEQ ID NO: 3469 - RNA, 21 nt, Artificial Sequence
  Synthetic construct
aucuuuguuuaaaugugguuu

SEQ ID NO: 3470 - RNA, 21 nt, Artificial Sequence
  Synthetic construct
acaggaagcaauuucguguuu

SEQ ID NO: 3471 - RNA, 21 nt, Artificial Sequence
  Synthetic construct
uucaagcgauucucccaccuc

SEQ ID NO: 3472 - RNA, 21 nt, Artificial Sequence
  Synthetic construct
auacaggucucugugaccaca

SEQ ID NO: 3473 - RNA, 21 nt, Artificial Sequence
  Synthetic construct
aaacaacuguaaaugaauugg

SEQ ID NO: 3474 - RNA, 21 nt, Artificial Sequence
  Synthetic construct
uaacaaccugguuuacucaau

SEQ ID NO: 3475 - RNA, 21 nt, Artificial Sequence
  Synthetic construct
auaguuguaaucccuguuuau

SEQ ID NO: 3476 - RNA, 21 nt, Artificial Sequence
  Synthetic construct
gaaccugaacucaccuagcag

SEQ ID NO: 3477 - RNA, 21 nt, Artificial Sequence
  Synthetic construct
augaugauuaauguaucuauu

SEQ ID NO: 3478 - RNA, 21 nt, Artificial Sequence
  Synthetic construct
aagagaggauuaauuuaggua

SEQ ID NO: 3479 - RNA, 21 nt, Artificial Sequence
  Synthetic construct
guuuacagauaacacauucug

SEQ ID NO: 3480 - RNA, 21 nt, Artificial Sequence
  Synthetic construct
uaucuauuuccuccugguaug

SEQ ID NO: 3481 - RNA, 21 nt, Artificial Sequence
  Synthetic construct
auagauaauagucuccuaaga

SEQ ID NO: 3482 - RNA, 21 nt, Artificial Sequence
  Synthetic construct
uaucccacuguggacauuuuc

SEQ ID NO: 3483 - RNA, 21 nt, Artificial Sequence
  Synthetic construct
uugaauuucccggcacuauga

SEQ ID NO: 3484 - RNA, 21 nt, Artificial Sequence
  Synthetic construct
aauuuaguaauaaagcucaua

SEQ ID NO: 3485 - RNA, 21 nt, Artificial Sequence
  Synthetic construct
uugcaucccaggauuucauug

SEQ ID NO: 3486 - RNA, 21 nt, Artificial Sequence
  Synthetic construct
ucuuuccagcaguguacucau

SEQ ID NO: 3487 - RNA, 21 nt, Artificial Sequence
  Synthetic construct
uaccaucagcaggucuacaaa

SEQ ID NO: 3488 - RNA, 21 nt, Artificial Sequence
  Synthetic construct
ucaucuucuucuucuucuucc

SEQ ID NO: 3489 - RNA, 21 nt, Artificial Sequence
  Synthetic construct
auccauacaggucucugugac

SEQ ID NO: 3490 - RNA, 21 nt, Artificial Sequence
  Synthetic construct
uagcaaauaucucugcccugc

SEQ ID NO: 3491 - RNA, 21 nt, Artificial Sequence
  Synthetic construct
ucaggugauccgccugccuug

SEQ ID NO: 3492 - RNA, 21 nt, Artificial Sequence
  Synthetic construct
agagacucaggcuuaaacgug

SEQ ID NO: 3493 - RNA, 21 nt, Artificial Sequence
  Synthetic construct
ucugugaagaucuuaucauca

SEQ ID NO: 3494 - RNA, 21 nt, Artificial Sequence
  Synthetic construct
uuauuagaaauauacauaacu

SEQ ID NO: 3495 - RNA, 21 nt, Artificial Sequence
  Synthetic construct
agcuucucuaagaucuccuca

SEQ ID NO: 3496 - RNA, 21 nt, Artificial Sequence
  Synthetic construct
aaccacagaacgaguauagau

SEQ ID NO: 3497 - RNA, 21 nt, Artificial Sequence
  Synthetic construct
ucaggauucuggagcucugga

SEQ ID NO: 3498 - RNA, 21 nt, Artificial Sequence
  Synthetic construct
uacaaauaaauuacauaaucu

SEQ ID NO: 3499 - RNA, 21 nt, Artificial Sequence
  Synthetic construct
ucauuaauaauuaauuccuuc

SEQ ID NO: 3500 - RNA, 21 nt, Artificial Sequence
  Synthetic construct
uaauuguaacuagcaaauauc

SEQ ID NO: 3501 - RNA, 21 nt, Artificial Sequence
  Synthetic construct
uuaaggccucucucucucauu

SEQ ID NO: 3502 - RNA, 21 nt, Artificial Sequence
  Synthetic construct
cauuucucucugcaacuugua

SEQ ID NO: 3503 - RNA, 21 nt, Artificial Sequence
  Synthetic construct
ucuaaauaauuaacaauauua

SEQ ID NO: 3504 - RNA, 21 nt, Artificial Sequence
  Synthetic construct
acaaccuauaaauaggcagaa

SEQ ID NO: 3505 - RNA, 21 nt, Artificial Sequence
  Synthetic construct
uugggcugcgauucaggcuua

SEQ ID NO: 3506 - RNA, 21 nt, Artificial Sequence
  Synthetic construct
aagagaauaaacuguuaacaa

SEQ ID NO: 3507 - RNA, 21 nt, Artificial Sequence
  Synthetic construct
auuuguaucauaaguaaauga

SEQ ID NO: 3508 - RNA, 21 nt, Artificial Sequence
  Synthetic construct
ugcaacauaagagacucaggc

SEQ ID NO: 3509 - RNA, 21 nt, Artificial Sequence
  Synthetic construct
uuagugggacuugcccuauug

SEQ ID NO: 3510 - RNA, 21 nt, Artificial Sequence
  Synthetic construct
auggaaccauaccaucagcag

SEQ ID NO: 3511 - RNA, 21 nt, Artificial Sequence
  Synthetic construct
ccaguagacaucacuacccug

SEQ ID NO: 3512 - RNA, 21 nt, Artificial Sequence
  Synthetic construct
ucccauuuauuuccuucccag

SEQ ID NO: 3513 - RNA, 21 nt, Artificial Sequence
  Synthetic construct
gaacuaagcaugaacacacca

SEQ ID NO: 3514 - RNA, 21 nt, Artificial Sequence
  Synthetic construct
cuuuauuugguacugcuggug

SEQ ID NO: 3515 - RNA, 21 nt, Artificial Sequence
  Synthetic construct
aauaaauuacauaaucugagg

SEQ ID NO: 3516 - RNA, 21 nt, Artificial Sequence
  Synthetic construct
uuccauuauuuccaaguuccc

SEQ ID NO: 3517 - RNA, 21 nt, Artificial Sequence
  Synthetic construct
aucagcaagaacgaagucauu

SEQ ID NO: 3518 - RNA, 21 nt, Artificial Sequence
  Synthetic construct
cuaacaacauuaacguucuuu

SEQ ID NO: 3519 - RNA, 21 nt, Artificial Sequence
  Synthetic construct
aacagaacuauaacugaaugc

SEQ ID NO: 3520 - RNA, 21 nt, Artificial Sequence
  Synthetic construct
acaaauuaauuugucaacauu

SEQ ID NO: 3521 - RNA, 21 nt, Artificial Sequence
  Synthetic construct
ucguacacacaggugugcaca

SEQ ID NO: 3522 - RNA, 21 nt, Artificial Sequence
  Synthetic construct
guucacacaguacuugcucug

SEQ ID NO: 3523 - RNA, 21 nt, Artificial Sequence
  Synthetic construct
acacguacacuauauaguuug

SEQ ID NO: 3524 - RNA, 21 nt, Artificial Sequence
  Synthetic construct
aaagacccuaaggaucaucua

SEQ ID NO: 3525 - RNA, 21 nt, Artificial Sequence
  Synthetic construct
uuacaggcccagauucguuuu

SEQ ID NO: 3526 - RNA, 21 nt, Artificial Sequence
  Synthetic construct
cucaaguacaguuauauucua

SEQ ID NO: 3527 - RNA, 21 nt, Artificial Sequence
  Synthetic construct
uggaaagacccuaaggaucau

SEQ ID NO: 3528 - RNA, 21 nt, Artificial Sequence
  Synthetic construct
aaaggcaauaucugcaacaga

SEQ ID NO: 3529 - RNA, 21 nt, Artificial Sequence
  Synthetic construct
caugaacacaccauauuccga

SEQ ID NO: 3530 - RNA, 21 nt, Artificial Sequence
  Synthetic construct
acuuaaaggaguguggaucag

SEQ ID NO: 3531 - RNA, 21 nt, Artificial Sequence
  Synthetic construct
uugcaggcacucucugcagac

SEQ ID NO: 3532 - RNA, 21 nt, Artificial Sequence
  Synthetic construct
uguuuggaguucuaauaguga

SEQ ID NO: 3533 - RNA, 21 nt, Artificial Sequence
  Synthetic construct
ugacauuucuugggauaugau

SEQ ID NO: 3534 - RNA, 21 nt, Artificial Sequence
  Synthetic construct
uucacucuuagcagucucagc

SEQ ID NO: 3535 - RNA, 21 nt, Artificial Sequence
  Synthetic construct
uacaaaugcugaauuucaguc

SEQ ID NO: 3536 - RNA, 21 nt, Artificial Sequence
  Synthetic construct
aaauaaucucuacugugcuuc

SEQ ID NO: 3537 - RNA, 21 nt, Artificial Sequence
  Synthetic construct
aagaauaaauacuugaguuaa

SEQ ID NO: 3538 - RNA, 21 nt, Artificial Sequence
  Synthetic construct
ucacaguuucaguuucagugu

SEQ ID NO: 3539 - RNA, 21 nt, Artificial Sequence
  Synthetic construct
acuacugcaaacaaccuauaa

SEQ ID NO: 3540 - RNA, 21 nt, Artificial Sequence
  Synthetic construct
auugggauguagccuucacug

SEQ ID NO: 3541 - RNA, 21 nt, Artificial Sequence
  Synthetic construct
aaguagcuuagauaaagacca

SEQ ID NO: 3542 - RNA, 21 nt, Artificial Sequence
  Synthetic construct
aaugaugauuaauguaucuau

SEQ ID NO: 3543 - RNA, 21 nt, Artificial Sequence
  Synthetic construct
acaggauucugugaagaucuu

SEQ ID NO: 3544 - RNA, 21 nt, Artificial Sequence
  Synthetic construct
uagguccaaguuucaaacugc

SEQ ID NO: 3545 - RNA, 21 nt, Artificial Sequence
  Synthetic construct
agcuucuaaaggagacuccga

SEQ ID NO: 3546 - RNA, 21 nt, Artificial Sequence
  Synthetic construct
aaucacugugggaguugucau

SEQ ID NO: 3547 - RNA, 21 nt, Artificial Sequence
  Synthetic construct
uaaacucuagaaagcccagca

SEQ ID NO: 3548 - RNA, 21 nt, Artificial Sequence
  Synthetic construct
ucaggcuggucucgaacuccu

SEQ ID NO: 3549 - RNA, 21 nt, Artificial Sequence
  Synthetic construct
auguccaacaaggauuucagu

SEQ ID NO: 3550 - RNA, 21 nt, Artificial Sequence
  Synthetic construct
uuuggagcugugguugagugc

SEQ ID NO: 3551 - RNA, 21 nt, Artificial Sequence
  Synthetic construct
caggcuggucucgaacuccug

SEQ ID NO: 3552 - RNA, 21 nt, Artificial Sequence
  Synthetic construct
ugaaucguaugcucaaagucu

SEQ ID NO: 3553 - RNA, 21 nt, Artificial Sequence
  Synthetic construct
ucaccguuugagcuuuauuua

SEQ ID NO: 3554 - RNA, 21 nt, Artificial Sequence
  Synthetic construct
aaucgugcccauugcucugga

SEQ ID NO: 3555 - RNA, 21 nt, Artificial Sequence
  Synthetic construct
gaauguuuacuauaucaccuu

SEQ ID NO: 3556 - RNA, 21 nt, Artificial Sequence
  Synthetic construct
uguaucauaaguaaaugauga

SEQ ID NO: 3557 - RNA, 21 nt, Artificial Sequence
  Synthetic construct
uaacaauauuaggguucuuau

SEQ ID NO: 3558 - RNA, 21 nt, Artificial Sequence
  Synthetic construct
cugaauuugcaaggcaaccua

SEQ ID NO: 3559 - RNA, 21 nt, Artificial Sequence
  Synthetic construct
uuguaaagcaauauuauaaca

SEQ ID NO: 3560 - RNA, 21 nt, Artificial Sequence
  Synthetic construct
uacccucuuuccagcagugua

SEQ ID NO: 3561 - RNA, 21 nt, Artificial Sequence
  Synthetic construct
aacaauauuaggguucuuauu

SEQ ID NO: 3562 - RNA, 21 nt, Artificial Sequence
  Synthetic construct
aauuaauuccuucuuggguug

SEQ ID NO: 3563 - RNA, 21 nt, Artificial Sequence
  Synthetic construct
ucagagacugggagauacuug

SEQ ID NO: 3564 - RNA, 21 nt, Artificial Sequence
  Synthetic construct
caaguuguauagaauacucgu

SEQ ID NO: 3565 - RNA, 21 nt, Artificial Sequence
  Synthetic construct
uucucucugcaacuuguaagu

SEQ ID NO: 3566 - RNA, 21 nt, Artificial Sequence
  Synthetic construct
ucacaaugcuucuuagcuucu

SEQ ID NO: 3567 - RNA, 21 nt, Artificial Sequence
  Synthetic construct
uguccauaugcauuucuuuuu

SEQ ID NO: 3568 - RNA, 21 nt, Artificial Sequence
  Synthetic construct
aacauaagagacucaggcuua

SEQ ID NO: 3569 - RNA, 21 nt, Artificial Sequence
  Synthetic construct
uugaaauuagugggacuugcc

SEQ ID NO: 3570 - RNA, 21 nt, Artificial Sequence
  Synthetic construct
uccuucccaguccacaugcaa

SEQ ID NO: 3571 - RNA, 21 nt, Artificial Sequence
  Synthetic construct
aauauuaaacacauucccaau

SEQ ID NO: 3572 - RNA, 21 nt, Artificial Sequence
  Synthetic construct
uguauagaauacucguacaca

SEQ ID NO: 3573 - RNA, 21 nt, Artificial Sequence
  Synthetic construct
cuguugaagguucaucugcuu

SEQ ID NO: 3574 - RNA, 21 nt, Artificial Sequence
  Synthetic construct
uaggagaaauauuccauuauu

SEQ ID NO: 3575 - RNA, 21 nt, Artificial Sequence
  Synthetic construct
cacacauugaacuugaauuuu

SEQ ID NO: 3576 - RNA, 21 nt, Artificial Sequence
  Synthetic construct
guuguuacuauucauccucag

SEQ ID NO: 3577 - RNA, 21 nt, Artificial Sequence
  Synthetic construct
acagaguugaauguuuacuau

SEQ ID NO: 3578 - RNA, 21 nt, Artificial Sequence
  Synthetic construct
uucaccguuugagcuuuauuu

SEQ ID NO: 3579 - RNA, 21 nt, Artificial Sequence
  Synthetic construct
caauggaaugugcuucaccgg

SEQ ID NO: 3580 - RNA, 21 nt, Artificial Sequence
  Synthetic construct
uguuggucaggcuggucucga

SEQ ID NO: 3581 - RNA, 21 nt, Artificial Sequence
  Synthetic construct
uguccuguugcaaugucuagu

SEQ ID NO: 3582 - RNA, 21 nt, Artificial Sequence
  Synthetic construct
cuucuauugaaauuaguggga

SEQ ID NO: 3583 - RNA, 21 nt, Artificial Sequence
  Synthetic construct
uauauucuagcaagugugaca

SEQ ID NO: 3584 - RNA, 21 nt, Artificial Sequence
  Synthetic construct
uaaaggaguguggaucagaaa

SEQ ID NO: 3585 - RNA, 21 nt, Artificial Sequence
  Synthetic construct
uugcugaaacucuaaagaaag

SEQ ID NO: 3586 - RNA, 21 nt, Artificial Sequence
  Synthetic construct
uuucuaauacuuauuagaaau

SEQ ID NO: 3587 - RNA, 21 nt, Artificial Sequence
  Synthetic construct
uuugcuuaacugaauauuaac

SEQ ID NO: 3588 - RNA, 21 nt, Artificial Sequence
  Synthetic construct
uucacgguggaagugaccacu

SEQ ID NO: 3589 - RNA, 21 nt, Artificial Sequence
  Synthetic construct
aggucucugugaccacaucag

SEQ ID NO: 3590 - RNA, 21 nt, Artificial Sequence
  Synthetic construct
ugacaacgcacuggauccuug

SEQ ID NO: 3591 - RNA, 21 nt, Artificial Sequence
  Synthetic construct
uccucuucaucuucuucuuca

SEQ ID NO: 3592 - RNA, 21 nt, Artificial Sequence
  Synthetic construct
auacagacaacaggaagcaau

SEQ ID NO: 3593 - RNA, 21 nt, Artificial Sequence
  Synthetic construct
gauguuaugaguauaauccca

SEQ ID NO: 3594 - RNA, 21 nt, Artificial Sequence
  Synthetic construct
auuuaucccacuacaucugac

SEQ ID NO: 3595 - RNA, 21 nt, Artificial Sequence
  Synthetic construct
auauauggaugguuagaugga

SEQ ID NO: 3596 - RNA, 21 nt, Artificial Sequence
  Synthetic construct
uaaguaaaugaugauuaaugu

SEQ ID NO: 3597 - RNA, 21 nt, Artificial Sequence
  Synthetic construct
auuaucuuuguuuacuuaaug

SEQ ID NO: 3598 - RNA, 21 nt, Artificial Sequence
  Synthetic construct
cagaacuauaacugaaugcca

SEQ ID NO: 3599 - RNA, 21 nt, Artificial Sequence
  Synthetic construct
aaagcauaagagagaagccau

SEQ ID NO: 3600 - RNA, 21 nt, Artificial Sequence
  Synthetic construct
agaaguuucuauucauuugaa

SEQ ID NO: 3601 - RNA, 21 nt, Artificial Sequence
  Synthetic construct
aauuauuuacacgaucuuuga

SEQ ID NO: 3602 - RNA, 21 nt, Artificial Sequence
  Synthetic construct
ugcugaggucagaaggaugga

SEQ ID NO: 3603 - RNA, 21 nt, Artificial Sequence
  Synthetic construct
aaauuaauauuaccguuucau

SEQ ID NO: 3604 - RNA, 21 nt, Artificial Sequence
  Synthetic construct
ucauugaauuucccggcacua

SEQ ID NO: 3605 - RNA, 21 nt, Artificial Sequence
  Synthetic construct
uuauuuacacgaucuuugagc

SEQ ID NO: 3606 - RNA, 21 nt, Artificial Sequence
  Synthetic construct
uuggaugcugaggucagaagg

SEQ ID NO: 3607 - RNA, 21 nt, Artificial Sequence
  Synthetic construct
uuuaaugauuucaaagucagc

SEQ ID NO: 3608 - RNA, 21 nt, Artificial Sequence
  Synthetic construct
aaguucaacccaauuaagugg

SEQ ID NO: 3609 - RNA, 21 nt, Artificial Sequence
  Synthetic construct
aaaugagauacaauucugaua

SEQ ID NO: 3610 - RNA, 21 nt, Artificial Sequence
  Synthetic construct
guagccuucacugaccuccca

SEQ ID NO: 3611 - RNA, 21 nt, Artificial Sequence
  Synthetic construct
aggauggaaccauaccaucag

SEQ ID NO: 3612 - RNA, 21 nt, Artificial Sequence
  Synthetic construct
auccuugcuaacaacauuaac

SEQ ID NO: 3613 - RNA, 21 nt, Artificial Sequence
  Synthetic construct
uucaggcuuacaaauaaauua

SEQ ID NO: 3614 - RNA, 21 nt, Artificial Sequence
  Synthetic construct
ucuuguccuguugcaaugucu

SEQ ID NO: 3615 - RNA, 21 nt, Artificial Sequence
  Synthetic construct
acagacaacaggaagcaauuu

SEQ ID NO: 3616 - RNA, 21 nt, Artificial Sequence
  Synthetic construct
uuacagaguugaauguuuacu

SEQ ID NO: 3617 - RNA, 21 nt, Artificial Sequence
  Synthetic construct
aacaacauuaacguucuuucc

SEQ ID NO: 3618 - RNA, 21 nt, Artificial Sequence
  Synthetic construct
aucugaggugacuaccucauu

SEQ ID NO: 3619 - RNA, 21 nt, Artificial Sequence
  Synthetic construct
aaucccaguagacaucacuac

SEQ ID NO: 3620 - RNA, 21 nt, Artificial Sequence
  Synthetic construct
aaguauuucuguauugagaau

SEQ ID NO: 3621 - RNA, 21 nt, Artificial Sequence
  Synthetic construct
auuaauauuaccguuucauuu

SEQ ID NO: 3622 - RNA, 21 nt, Artificial Sequence
  Synthetic construct
uauccuuugguuagauggucu

SEQ ID NO: 3623 - RNA, 21 nt, Artificial Sequence
  Synthetic construct
agaagaauauugucacucuuu

SEQ ID NO: 3624 - RNA, 21 nt, Artificial Sequence
  Synthetic construct
cuucuucuucuucuuccucuu

SEQ ID NO: 3625 - RNA, 21 nt, Artificial Sequence
  Synthetic construct
ucauuagaaauaaacccauug

SEQ ID NO: 3626 - RNA, 21 nt, Artificial Sequence
  Synthetic construct
uuauagacaaauaucucaaac

SEQ ID NO: 3627 - RNA, 21 nt, Artificial Sequence
  Synthetic construct
aacugaaagcauaagagagaa

SEQ ID NO: 3628 - RNA, 21 nt, Artificial Sequence
  Synthetic construct
auuucaguauucuacauuuau

SEQ ID NO: 3629 - RNA, 21 nt, Artificial Sequence
  Synthetic construct
aucauuuauagacaaauaucu

SEQ ID NO: 3630 - RNA, 21 nt, Artificial Sequence
  Synthetic construct
ucauaacuucuauugaaauua

SEQ ID NO: 3631 - RNA, 21 nt, Artificial Sequence
  Synthetic construct
cauaacucuccaauacaggga

SEQ ID NO: 3632 - RNA, 21 nt, Artificial Sequence
  Synthetic construct
aaauaggugauacauaggaaa

SEQ ID NO: 3633 - RNA, 21 nt, Artificial Sequence
  Synthetic construct
aucacaacuacugcaaacaac

SEQ ID NO: 3634 - RNA, 21 nt, Artificial Sequence
  Synthetic construct
augaaucguaugcucaaaguc

SEQ ID NO: 3635 - RNA, 21 nt, Artificial Sequence
  Synthetic construct
uggaguucuaauagugacauc

SEQ ID NO: 3636 - RNA, 21 nt, Artificial Sequence
  Synthetic construct
uauuuauuguaaagcaauauu

SEQ ID NO: 3637 - RNA, 21 nt, Artificial Sequence
  Synthetic construct
caaaugugaauccuucagcau

SEQ ID NO: 3638 - RNA, 21 nt, Artificial Sequence
  Synthetic construct
auugcucuggaauuccaguga

SEQ ID NO: 3639 - RNA, 21 nt, Artificial Sequence
  Synthetic construct
auuucugguuguugacuguuu

SEQ ID NO: 3640 - RNA, 21 nt, Artificial Sequence
  Synthetic construct
guauuuaucccacuacaucug

SEQ ID NO: 3641 - RNA, 21 nt, Artificial Sequence
  Synthetic construct
uucccagucuuuguccauaug

SEQ ID NO: 3642 - RNA, 21 nt, Artificial Sequence
  Synthetic construct
cuaauagugacaucucccuag

SEQ ID NO: 3643 - RNA, 21 nt, Artificial Sequence
  Synthetic construct
uguuuaaaugugguuucuccu

SEQ ID NO: 3644 - RNA, 21 nt, Artificial Sequence
  Synthetic construct
uuccucuuggguacuaaaucu

SEQ ID NO: 3645 - RNA, 21 nt, Artificial Sequence
  Synthetic construct
agcaguguacucaucauacaa

SEQ ID NO: 3646 - RNA, 21 nt, Artificial Sequence
  Synthetic construct
ucguuaucucagggcacacua

SEQ ID NO: 3647 - RNA, 21 nt, Artificial Sequence
  Synthetic construct
cucuacugugcuucucacccu

SEQ ID NO: 3648 - RNA, 21 nt, Artificial Sequence
  Synthetic construct
guaacuagcaaauaucucugc

SEQ ID NO: 3649 - RNA, 21 nt, Artificial Sequence
  Synthetic construct
uggugaguuagaaggaaguua

SEQ ID NO: 3650 - RNA, 21 nt, Artificial Sequence
  Synthetic construct
caaugcuucuuagcuucucua

SEQ ID NO: 3651 - RNA, 21 nt, Artificial Sequence
  Synthetic construct
auaaauaauuuguaucauaag

SEQ ID NO: 3652 - RNA, 21 nt, Artificial Sequence
  Synthetic construct
aaguucuguuuagauucuuuu

SEQ ID NO: 3653 - RNA, 21 nt, Artificial Sequence
  Synthetic construct
caacgcacuggauccuugcua

SEQ ID NO: 3654 - RNA, 21 nt, Artificial Sequence
  Synthetic construct
ugauuucaaagucagcuuuua

SEQ ID NO: 3655 - RNA, 21 nt, Artificial Sequence
  Synthetic construct
uaaagcacaccacacacaagc

SEQ ID NO: 3656 - RNA, 21 nt, Artificial Sequence
  Synthetic construct
uugcggguccauaaagcacac

SEQ ID NO: 3657 - RNA, 21 nt, Artificial Sequence
  Synthetic construct
uuugagcuuuauuuagauaua

SEQ ID NO: 3658 - RNA, 21 nt, Artificial Sequence
  Synthetic construct
auggaauaauuguaacuagca

SEQ ID NO: 3659 - RNA, 21 nt, Artificial Sequence
  Synthetic construct
uugcuuaacugaauauuaacu

SEQ ID NO: 3660 - RNA, 21 nt, Artificial Sequence
  Synthetic construct
cacaguuucaguuucagugug

SEQ ID NO: 3661 - RNA, 21 nt, Artificial Sequence
  Synthetic construct
aucgugcccauugcucuggaa

SEQ ID NO: 3662 - RNA, 21 nt, Artificial Sequence
  Synthetic construct
ucacgguggaagugaccacuu

SEQ ID NO: 3663 - RNA, 21 nt, Artificial Sequence
  Synthetic construct
cuaaaucuguugaacauguug

SEQ ID NO: 3664 - RNA, 21 nt, Artificial Sequence
  Synthetic construct
agcaauuuaguaauaaagcuc

SEQ ID NO: 3665 - RNA, 21 nt, Artificial Sequence
  Synthetic construct
ugggauaugauuguaaguuaa

SEQ ID NO: 3666 - RNA, 21 nt, Artificial Sequence
  Synthetic construct
uagcaggcugaauuugcaagg

SEQ ID NO: 3667 - RNA, 21 nt, Artificial Sequence
  Synthetic construct
uacagugcauauguuucauaa

SEQ ID NO: 3668 - RNA, 21 nt, Artificial Sequence
  Synthetic construct
uucaaaucccaggcccaucaa

SEQ ID NO: 3669 - RNA, 21 nt, Artificial Sequence
  Synthetic construct
uucucccaccucagccuccca

SEQ ID NO: 3670 - RNA, 21 nt, Artificial Sequence
  Synthetic construct
uuaaaggaguguggaucagaa

SEQ ID NO: 3671 - RNA, 21 nt, Artificial Sequence
  Synthetic construct
uagauaaagaccaagagauuc

SEQ ID NO: 3672 - RNA, 21 nt, Artificial Sequence
  Synthetic construct
ucaacauugcugcccuguuug

SEQ ID NO: 3673 - RNA, 21 nt, Artificial Sequence
  Synthetic construct
uccauaaagcacaccacacac

SEQ ID NO: 3674 - RNA, 21 nt, Artificial Sequence
  Synthetic construct
ugcaacucuauuagggcaugg

SEQ ID NO: 3675 - RNA, 21 nt, Artificial Sequence
  Synthetic construct
auguuuacuauaucaccuuuc

SEQ ID NO: 3676 - RNA, 21 nt, Artificial Sequence
  Synthetic construct
ugaagguucaucugcuuuaug

SEQ ID NO: 3677 - RNA, 21 nt, Artificial Sequence
  Synthetic construct
uaguuguaaucccuguuuaug

SEQ ID NO: 3678 - RNA, 21 nt, Artificial Sequence
  Synthetic construct
gaucuuaucaucaauaaugaa

SEQ ID NO: 3679 - RNA, 21 nt, Artificial Sequence
  Synthetic construct
auggagagguuaagugacuug

SEQ ID NO: 3680 - RNA, 21 nt, Artificial Sequence
  Synthetic construct
uauggaauaauuguaacuagc

SEQ ID NO: 3681 - RNA, 21 nt, Artificial Sequence
  Synthetic construct
augcaugggcucugcuaucuu

SEQ ID NO: 3682 - RNA, 21 nt, Artificial Sequence
  Synthetic construct
ucgauuguaccaaaugugaau

SEQ ID NO: 3683 - RNA, 21 nt, Artificial Sequence
  Synthetic construct
cauaucugaggugacuaccuc

SEQ ID NO: 3684 - RNA, 21 nt, Artificial Sequence
  Synthetic construct
aagaacuaagcaugaacacac

SEQ ID NO: 3685 - RNA, 21 nt, Artificial Sequence
  Synthetic construct
uuuaucccacuacaucugacu

SEQ ID NO: 3686 - RNA, 21 nt, Artificial Sequence
  Synthetic construct
auuccaugacuacccauaguu

SEQ ID NO: 3687 - RNA, 21 nt, Artificial Sequence
  Synthetic construct
uaaacacauucccaaugcaug

SEQ ID NO: 3688 - RNA, 21 nt, Artificial Sequence
  Synthetic construct
auucauuugaaagguaaagaa

SEQ ID NO: 3689 - RNA, 21 nt, Artificial Sequence
  Synthetic construct
auaggagaaauauuccauuau

SEQ ID NO: 3690 - RNA, 21 nt, Artificial Sequence
  Synthetic construct
ucuuagcggcugcuguucuua

SEQ ID NO: 3691 - RNA, 21 nt, Artificial Sequence
  Synthetic construct
uaugcuucaaauuaauauuac

SEQ ID NO: 3692 - RNA, 21 nt, Artificial Sequence
  Synthetic construct
uggaugguuagauggauggau

SEQ ID NO: 3693 - RNA, 21 nt, Artificial Sequence
  Synthetic construct
aaagaacuaagcaugaacaca

SEQ ID NO: 3694 - RNA, 21 nt, Artificial Sequence
  Synthetic construct
aaggagguuugaaugcaagag

SEQ ID NO: 3695 - RNA, 21 nt, Artificial Sequence
  Synthetic construct
ucuauggaucaccugguuuga

SEQ ID NO: 3696 - RNA, 21 nt, Artificial Sequence
  Synthetic construct
auggaugguuagauggaugga

SEQ ID NO: 3697 - RNA, 21 nt, Artificial Sequence
  Synthetic construct
acacaccauauuccgaaacag

SEQ ID NO: 3698 - RNA, 21 nt, Artificial Sequence
  Synthetic construct
augguuagauggauggaugua

SEQ ID NO: 3699 - RNA, 21 nt, Artificial Sequence
  Synthetic construct
agauacaauucugauaaacaa

SEQ ID NO: 3700 - RNA, 21 nt, Artificial Sequence
  Synthetic construct
aguagcuaucuaaauaauuaa

SEQ ID NO: 3701 - RNA, 21 nt, Artificial Sequence
  Synthetic construct
uccacaugcaaauacacguuc

SEQ ID NO: 3702 - RNA, 21 nt, Artificial Sequence
  Synthetic construct
aguuacagaagaauuucacua

SEQ ID NO: 3703 - RNA, 21 nt, Artificial Sequence
  Synthetic construct
uugaaugcaagagggacuacu

SEQ ID NO: 3704 - RNA, 21 nt, Artificial Sequence
  Synthetic construct
caggauucugugaagaucuua

SEQ ID NO: 3705 - RNA, 21 nt, Artificial Sequence
  Synthetic construct
cugaacacacauauuccucuc

SEQ ID NO: 3706 - RNA, 21 nt, Artificial Sequence
  Synthetic construct
acucaagacacagucaugcac

SEQ ID NO: 3707 - RNA, 21 nt, Artificial Sequence
  Synthetic construct
auuauaacaauaucaaauaaa

SEQ ID NO: 3708 - RNA, 21 nt, Artificial Sequence
  Synthetic construct
ucuuucagguauuaaggagau

SEQ ID NO: 3709 - RNA, 21 nt, Artificial Sequence
  Synthetic construct
ucccaucuuuguuuaaaugug

SEQ ID NO: 3710 - RNA, 21 nt, Artificial Sequence
  Synthetic construct
aauuguaacuagcaaauaucu

SEQ ID NO: 3711 - RNA, 21 nt, Artificial Sequence
  Synthetic construct
aacuaagcagcauaucugagg

SEQ ID NO: 3712 - RNA, 21 nt, Artificial Sequence
  Synthetic construct
agauguaaggaucaggugguu

SEQ ID NO: 3713 - RNA, 21 nt, Artificial Sequence
  Synthetic construct
aauuagugggacuugcccuau

SEQ ID NO: 3714 - RNA, 21 nt, Artificial Sequence
  Synthetic construct
aguuuggaguaaucgugccca

SEQ ID NO: 3715 - RNA, 21 nt, Artificial Sequence
  Synthetic construct
caaaucuugguacaaaguggu

SEQ ID NO: 3716 - RNA, 21 nt, Artificial Sequence
  Synthetic construct
acuuugcucaggagugaucug

SEQ ID NO: 3717 - RNA, 21 nt, Artificial Sequence
  Synthetic construct
ucuucaaagugaaugcacaaa

SEQ ID NO: 3718 - RNA, 21 nt, Artificial Sequence
  Synthetic construct
auuauuuccaaguucccauuu

SEQ ID NO: 3719 - RNA, 21 nt, Artificial Sequence
  Synthetic construct
ucaacauuucucaaugcuaau

SEQ ID NO: 3720 - RNA, 21 nt, Artificial Sequence
  Synthetic construct
aggaggucaagccucucccaa

SEQ ID NO: 3721 - RNA, 21 nt, Artificial Sequence
  Synthetic construct
aguagacaucacuacccugug

SEQ ID NO: 3722 - RNA, 21 nt, Artificial Sequence
  Synthetic construct
ugacaggauuucaccguuuga

SEQ ID NO: 3723 - RNA, 21 nt, Artificial Sequence
  Synthetic construct
ucuuccuaggcuaguauuuau

SEQ ID NO: 3724 - RNA, 21 nt, Artificial Sequence
  Synthetic construct
ucaacauguaagggaugcuaa

SEQ ID NO: 3725 - RNA, 21 nt, Artificial Sequence
  Synthetic construct
caucuucuucuucuucuuccu

SEQ ID NO: 3726 - RNA, 21 nt, Artificial Sequence
  Synthetic construct
uaauagugacaucucccuagc

SEQ ID NO: 3727 - RNA, 21 nt, Artificial Sequence
  Synthetic construct
gcuuagagaaacaacuuucug

SEQ ID NO: 3728 - RNA, 21 nt, Artificial Sequence
  Synthetic construct
caucuagaacagcuugugggu

SEQ ID NO: 3729 - RNA, 21 nt, Artificial Sequence
  Synthetic construct
ucuucaucuucuucuucagac

SEQ ID NO: 3730 - RNA, 21 nt, Artificial Sequence
  Synthetic construct
aaaugcuacaaguuguauaga

SEQ ID NO: 3731 - RNA, 21 nt, Artificial Sequence
  Synthetic construct
uuugguucccaacaaauuaau

SEQ ID NO: 3732 - RNA, 21 nt, Artificial Sequence
  Synthetic construct
uaucaacuuucggaccauaag

SEQ ID NO: 3733 - RNA, 21 nt, Artificial Sequence
  Synthetic construct
aagcuugcaggcacucucugc

SEQ ID NO: 3734 - RNA, 21 nt, Artificial Sequence
  Synthetic construct
cuauguauccaugugcacuuu

SEQ ID NO: 3735 - RNA, 21 nt, Artificial Sequence
  Synthetic construct
augggauagcauuugccugau

SEQ ID NO: 3736 - RNA, 21 nt, Artificial Sequence
  Synthetic construct
uaaagccuauggaauaauugu

SEQ ID NO: 3737 - RNA, 21 nt, Artificial Sequence
  Synthetic construct
uagcugggauuacaggcgccc

SEQ ID NO: 3738 - RNA, 21 nt, Artificial Sequence
  Synthetic construct
ucaggagugaucugggcacag

SEQ ID NO: 3739 - RNA, 21 nt, Artificial Sequence
  Synthetic construct
agugcuucguuuacuuugcuc

SEQ ID NO: 3740 - RNA, 21 nt, Artificial Sequence
  Synthetic construct
ucguuuacuuugcucaggagu

SEQ ID NO: 3741 - RNA, 21 nt, Artificial Sequence
  Synthetic construct
ucacucuuagcagucucagcc

SEQ ID NO: 3742 - RNA, 21 nt, Artificial Sequence
  Synthetic construct
uaugaggauuuccuagguuca

SEQ ID NO: 3743 - RNA, 21 nt, Artificial Sequence
  Synthetic construct
uaauuuguaucauaaguaaau

SEQ ID NO: 3744 - RNA, 21 nt, Artificial Sequence
  Synthetic construct
auuaauguaucuauuuccucc

SEQ ID NO: 3745 - RNA, 21 nt, Artificial Sequence
  Synthetic construct
acacaacacuaugaagaggga

SEQ ID NO: 3746 - RNA, 21 nt, Artificial Sequence
  Synthetic construct
aaaugaauuggaaggcugcca

SEQ ID NO: 3747 - RNA, 21 nt, Artificial Sequence
  Synthetic construct
aaguagcugggauuacaggcg

SEQ ID NO: 3748 - RNA, 21 nt, Artificial Sequence
  Synthetic construct
caucuaaugacaaugcaagug

SEQ ID NO: 3749 - RNA, 21 nt, Artificial Sequence
  Synthetic construct
ucuauguuggucaggcugguc

SEQ ID NO: 3750 - RNA, 21 nt, Artificial Sequence
  Synthetic construct
cugaguucacuucaaauccca

SEQ ID NO: 3751 - RNA, 21 nt, Artificial Sequence
  Synthetic construct
ucagagaaagucccaucuuug

SEQ ID NO: 3752 - RNA, 21 nt, Artificial Sequence
  Synthetic construct
auccucaguggaggagccggg

SEQ ID NO: 3753 - RNA, 21 nt, Artificial Sequence
  Synthetic construct
aagcaauuucguguuucuuuu

SEQ ID NO: 3754 - RNA, 21 nt, Artificial Sequence
  Synthetic construct
augagauacaauucugauaaa

SEQ ID NO: 3755 - RNA, 21 nt, Artificial Sequence
  Synthetic construct
uacauaaucugagggaguagg

SEQ ID NO: 3756 - RNA, 21 nt, Artificial Sequence
  Synthetic construct
ucuuugguucccaacaaauua

SEQ ID NO: 3757 - RNA, 21 nt, Artificial Sequence
  Synthetic construct
ugaagaucuuaucaucaauaa

SEQ ID NO: 3758 - RNA, 21 nt, Artificial Sequence
  Synthetic construct
auauugucacucuuuauaucu

SEQ ID NO: 3759 - RNA, 21 nt, Artificial Sequence
  Synthetic construct
ugguuuacagauaacacauuc

SEQ ID NO: 3760 - RNA, 21 nt, Artificial Sequence
  Synthetic construct
ucuucuucuuccucuucaucu

SEQ ID NO: 3761 - RNA, 21 nt, Artificial Sequence
  Synthetic construct
cugucggacugacauuucuug

SEQ ID NO: 3762 - RNA, 21 nt, Artificial Sequence
  Synthetic construct
cuccucauuguuaauaugcug

SEQ ID NO: 3763 - RNA, 21 nt, Artificial Sequence
  Synthetic construct
aaagaaaucugaauaacauaa

SEQ ID NO: 3764 - RNA, 21 nt, Artificial Sequence
  Synthetic construct
gacacagucacuaauguacug

SEQ ID NO: 3765 - RNA, 21 nt, Artificial Sequence
  Synthetic construct
uggguucaagcgauucuccca

SEQ ID NO: 3766 - RNA, 21 nt, Artificial Sequence
  Synthetic construct
aaccauaccaucagcaggucu

SEQ ID NO: 3767 - RNA, 21 nt, Artificial Sequence
  Synthetic construct
guauaacauaguaugcuucaa

SEQ ID NO: 3768 - RNA, 21 nt, Artificial Sequence
  Synthetic construct
auacuuuagguccaaguuuca

SEQ ID NO: 3769 - RNA, 21 nt, Artificial Sequence
  Synthetic construct
acauggugacugauuugaggg

SEQ ID NO: 3770 - RNA, 21 nt, Artificial Sequence
  Synthetic construct
uguuuagguucacucuuagca

SEQ ID NO: 3771 - RNA, 21 nt, Artificial Sequence
  Synthetic construct
agaaggaaguuauccuuuggu

SEQ ID NO: 3772 - RNA, 21 nt, Artificial Sequence
  Synthetic construct
acuaaugaauagggcuuccua

SEQ ID NO: 3773 - RNA, 21 nt, Artificial Sequence
  Synthetic construct
uccaugacuacccauaguuca

SEQ ID NO: 3774 - RNA, 21 nt, Artificial Sequence
  Synthetic construct
aaggaagagagaucucugggc

SEQ ID NO: 3775 - RNA, 21 nt, Artificial Sequence
  Synthetic construct
ucuaaagaaagugcuuucauu

SEQ ID NO: 3776 - RNA, 21 nt, Artificial Sequence
  Synthetic construct
cugaauguacauaaguucugu

SEQ ID NO: 3777 - RNA, 21 nt, Artificial Sequence
  Synthetic construct
uguacaaaguacuggaauugg

SEQ ID NO: 3778 - RNA, 21 nt, Artificial Sequence
  Synthetic construct
guguacucaucauacaacugg

SEQ ID NO: 3779 - RNA, 21 nt, Artificial Sequence
  Synthetic construct
uccagaaaggcaauaucugca

SEQ ID NO: 3780 - RNA, 21 nt, Artificial Sequence
  Synthetic construct
aauaugguauuugcgggucca

SEQ ID NO: 3781 - RNA, 21 nt, Artificial Sequence
  Synthetic construct
aauagauauauggugaaauag

SEQ ID NO: 3782 - RNA, 21 nt, Artificial Sequence
  Synthetic construct
auuuccuucccaguccacaug

SEQ ID NO: 3783 - RNA, 21 nt, Artificial Sequence
  Synthetic construct
cagacuuuacauacagacugu

SEQ ID NO: 3784 - RNA, 21 nt, Artificial Sequence
  Synthetic construct
cuuacugcugguauuauggga

SEQ ID NO: 3785 - RNA, 21 nt, Artificial Sequence
  Synthetic construct
ucauaaguaaaugaugauuaa

SEQ ID NO: 3786 - RNA, 21 nt, Artificial Sequence
  Synthetic construct
ucuguccuucauccauacagg

SEQ ID NO: 3787 - RNA, 21 nt, Artificial Sequence
  Synthetic construct
ugacuugccuagcgucacaua

SEQ ID NO: 3788 - RNA, 21 nt, Artificial Sequence
  Synthetic construct
caucugacucauucucuacua

SEQ ID NO: 3789 - RNA, 21 nt, Artificial Sequence
  Synthetic construct
augagggagauggugaggugu

SEQ ID NO: 3790 - RNA, 21 nt, Artificial Sequence
  Synthetic construct
guacacuauauaguuugcuga

SEQ ID NO: 3791 - RNA, 21 nt, Artificial Sequence
  Synthetic construct
uuucacucuuguugccgaggc

SEQ ID NO: 3792 - RNA, 21 nt, Artificial Sequence
  Synthetic construct
uacugcaaacaaccuauaaau

SEQ ID NO: 3793 - RNA, 21 nt, Artificial Sequence
  Synthetic construct
caacugauuucaauuaucugu

SEQ ID NO: 3794 - RNA, 21 nt, Artificial Sequence
  Synthetic construct
acauuguuuaauauuaaacac

SEQ ID NO: 3795 - RNA, 21 nt, Artificial Sequence
  Synthetic construct
caguuauacagacaacaggaa

SEQ ID NO: 3796 - RNA, 21 nt, Artificial Sequence
  Synthetic construct
uuugcaucccaggauuucauu

SEQ ID NO: 3797 - RNA, 21 nt, Artificial Sequence
  Synthetic construct
uaucauuuauagacaaauauc

SEQ ID NO: 3798 - RNA, 21 nt, Artificial Sequence
  Synthetic construct
ucccacuacaucugacucauu

SEQ ID NO: 3799 - RNA, 21 nt, Artificial Sequence
  Synthetic construct
uacaggcccagauucguuuuu

SEQ ID NO: 3800 - RNA, 21 nt, Artificial Sequence
  Synthetic construct
ucuacucucagaagauucagg

SEQ ID NO: 3801 - RNA, 21 nt, Artificial Sequence
  Synthetic construct
auuucagucuuacucaugagg

SEQ ID NO: 3802 - RNA, 21 nt, Artificial Sequence
  Synthetic construct
gaaacuaagcagcauaucuga

SEQ ID NO: 3803 - RNA, 21 nt, Artificial Sequence
  Synthetic construct
aaggaaguuauccuuugguua

SEQ ID NO: 3804 - RNA, 21 nt, Artificial Sequence
  Synthetic construct
cuucuucagacacaggagggg

SEQ ID NO: 3805 - RNA, 21 nt, Artificial Sequence
  Synthetic construct
uuagcggcugcuguucuuaau

SEQ ID NO: 3806 - RNA, 21 nt, Artificial Sequence
  Synthetic construct
uuucacuacacaugguuuaca

SEQ ID NO: 3807 - RNA, 21 nt, Artificial Sequence
  Synthetic construct
uggaacauggacacacaaaua

SEQ ID NO: 3808 - RNA, 21 nt, Artificial Sequence
  Synthetic construct
augucacaguuucaguuucag

SEQ ID NO: 3809 - RNA, 21 nt, Artificial Sequence
  Synthetic construct
uuaauccaaaguuacagaaga

SEQ ID NO: 3810 - RNA, 21 nt, Artificial Sequence
  Synthetic construct
ucucccaccucagccucccaa

SEQ ID NO: 3811 - RNA, 21 nt, Artificial Sequence
  Synthetic construct
aauagggcuuccuaaccaggu

SEQ ID NO: 3812 - RNA, 21 nt, Artificial Sequence
  Synthetic construct
agcacauggagaccaucccaa

SEQ ID NO: 3813 - RNA, 21 nt, Artificial Sequence
  Synthetic construct
ugcaacuuguaaguguuuagg

SEQ ID NO: 3814 - RNA, 21 nt, Artificial Sequence
  Synthetic construct
aagagacucaggcuuaaacgu

SEQ ID NO: 3815 - RNA, 21 nt, Artificial Sequence
  Synthetic construct
aauaaagcucauauuagacuc

SEQ ID NO: 3816 - RNA, 21 nt, Artificial Sequence
  Synthetic construct
uagcuaucuaaauaauuaaca

SEQ ID NO: 3817 - RNA, 21 nt, Artificial Sequence
  Synthetic construct
augcugaacugaaagcauaag

SEQ ID NO: 3818 - RNA, 21 nt, Artificial Sequence
  Synthetic construct
augaguauaaucccaguagac

SEQ ID NO: 3819 - RNA, 21 nt, Artificial Sequence
  Synthetic construct
acuaagcaugaacacaccaua

SEQ ID NO: 3820 - RNA, 21 nt, Artificial Sequence
  Synthetic construct
agugcaggaaauccaaagcuu

SEQ ID NO: 3821 - RNA, 21 nt, Artificial Sequence
  Synthetic construct
ugauaucucaguucccgcauu

SEQ ID NO: 3822 - RNA, 21 nt, Artificial Sequence
  Synthetic construct
aauauuauaacaauaucaaau

SEQ ID NO: 3823 - RNA, 21 nt, Artificial Sequence
  Synthetic construct
aguaauauccuguuggacaag

SEQ ID NO: 3824 - RNA, 21 nt, Artificial Sequence
  Synthetic construct
aaugcugaauuucaguccucu

SEQ ID NO: 3825 - RNA, 21 nt, Artificial Sequence
  Synthetic construct
uccucauuguuaauaugcuga

SEQ ID NO: 3826 - RNA, 21 nt, Artificial Sequence
  Synthetic construct
ugcaaaguauaacauaguaug

SEQ ID NO: 3827 - RNA, 21 nt, Artificial Sequence
  Synthetic construct
cagacagcugcuaucuguccu

SEQ ID NO: 3828 - RNA, 21 nt, Artificial Sequence
  Synthetic construct
auaguucccuuucugcuguuu

SEQ ID NO: 3829 - RNA, 21 nt, Artificial Sequence
  Synthetic construct
caggacacagucacuaaugua

SEQ ID NO: 3830 - RNA, 21 nt, Artificial Sequence
  Synthetic construct
acauaacucuccaauacaggg

SEQ ID NO: 3831 - RNA, 21 nt, Artificial Sequence
  Synthetic construct
uauucauuuggucacuuaaag

SEQ ID NO: 3832 - RNA, 21 nt, Artificial Sequence
  Synthetic construct
uaucugcaacagauguuauca

SEQ ID NO: 3833 - RNA, 21 nt, Artificial Sequence
  Synthetic construct
agaaauauuccauuauuucca

SEQ ID NO: 3834 - RNA, 21 nt, Artificial Sequence
  Synthetic construct
ugagguguaaggcuugcaguc

SEQ ID NO: 3835 - RNA, 21 nt, Artificial Sequence
  Synthetic construct
ugcccuauuccuaacucagga

SEQ ID NO: 3836 - RNA, 21 nt, Artificial Sequence
  Synthetic construct
uuuccagcaguguacucauca

SEQ ID NO: 3837 - RNA, 21 nt, Artificial Sequence
  Synthetic construct
aaagaaagugcuuucauuuua

SEQ ID NO: 3838 - RNA, 21 nt, Artificial Sequence
  Synthetic construct
aucuaaugacaaugcaaguga

SEQ ID NO: 3839 - RNA, 21 nt, Artificial Sequence
  Synthetic construct
aacuaaugaauagggcuuccu

SEQ ID NO: 3840 - RNA, 21 nt, Artificial Sequence
  Synthetic construct
ccuucuauaacacaaauuguu

SEQ ID NO: 3841 - RNA, 21 nt, Artificial Sequence
  Synthetic construct
uccaucucaagacagcgauuu

SEQ ID NO: 3842 - RNA, 21 nt, Artificial Sequence
  Synthetic construct
auauuccauuauuuccaaguu

SEQ ID NO: 3843 - RNA, 21 nt, Artificial Sequence
  Synthetic construct
ucacauuggguaaggaguuuu

SEQ ID NO: 3844 - RNA, 21 nt, Artificial Sequence
  Synthetic construct
accauaaauaccuuuaaucca

SEQ ID NO: 3845 - RNA, 21 nt, Artificial Sequence
  Synthetic construct
gugaucugggcacagaaccca

SEQ ID NO: 3846 - RNA, 21 nt, Artificial Sequence
  Synthetic construct
aaagugcugggauuacaggua

SEQ ID NO: 3847 - RNA, 21 nt, Artificial Sequence
  Synthetic construct
aagaaaucugaauaacauaaa

SEQ ID NO: 3848 - RNA, 21 nt, Artificial Sequence
  Synthetic construct
auugauugggauguagccuuc

SEQ ID NO: 3849 - RNA, 21 nt, Artificial Sequence
  Synthetic construct
acucguacacacaggugugca

SEQ ID NO: 3850 - RNA, 21 nt, Artificial Sequence
  Synthetic construct
augugguuucuccuaugagga

SEQ ID NO: 3851 - RNA, 21 nt, Artificial Sequence
  Synthetic construct
uacauacagacuguauggaaa

SEQ ID NO: 3852 - RNA, 21 nt, Artificial Sequence
  Synthetic construct
uauuuccuucccaguccacau

SEQ ID NO: 3853 - RNA, 21 nt, Artificial Sequence
  Synthetic construct
aacugucaguuuacaaaugcu

SEQ ID NO: 3854 - RNA, 21 nt, Artificial Sequence
  Synthetic construct
agguguaaggcuugcagucuu

SEQ ID NO: 3855 - RNA, 21 nt, Artificial Sequence
  Synthetic construct
gacacagucaugcacaaucca

SEQ ID NO: 3856 - RNA, 21 nt, Artificial Sequence
  Synthetic construct
aggagauuaacaaccugguuu

SEQ ID NO: 3857 - RNA, 21 nt, Artificial Sequence
  Synthetic construct
agaaacaacuuucuguaauuu

SEQ ID NO: 3858 - RNA, 21 nt, Artificial Sequence
  Synthetic construct
ugcuguaggcagggcauuggg

SEQ ID NO: 3859 - RNA, 21 nt, Artificial Sequence
  Synthetic construct
ugugcccucguuaucucaggg

SEQ ID NO: 3860 - RNA, 21 nt, Artificial Sequence
  Synthetic construct
acauaguuguaaucccuguuu

SEQ ID NO: 3861 - RNA, 21 nt, Artificial Sequence
  Synthetic construct
ucagcaagaacgaagucauua

SEQ ID NO: 3862 - RNA, 21 nt, Artificial Sequence
  Synthetic construct
agacauuuaugaauaugcuuu

SEQ ID NO: 3863 - RNA, 21 nt, Artificial Sequence
  Synthetic construct
uccaacaaggauuucaguauu

SEQ ID NO: 3864 - RNA, 21 nt, Artificial Sequence
  Synthetic construct
agcaauuucguguuucuuuuu

SEQ ID NO: 3865 - RNA, 21 nt, Artificial Sequence
  Synthetic construct
uuccaucuuuccugcagcaga

SEQ ID NO: 3866 - RNA, 21 nt, Artificial Sequence
  Synthetic construct
aauuucaagacauuuaugaau

SEQ ID NO: 3867 - RNA, 21 nt, Artificial Sequence
  Synthetic construct
uucuaauacuuauuagaaaua

SEQ ID NO: 3868 - RNA, 21 nt, Artificial Sequence
  Synthetic construct
cuucuuccucuucaucuucuu

SEQ ID NO: 3869 - RNA, 21 nt, Artificial Sequence
  Synthetic construct
ucacuacacaugguuuacaga

SEQ ID NO: 3870 - RNA, 21 nt, Artificial Sequence
  Synthetic construct
ucaaccugagagucuguuaaa

SEQ ID NO: 3871 - RNA, 21 nt, Artificial Sequence
  Synthetic construct
uuccaugacuacccauaguuc

SEQ ID NO: 3872 - RNA, 21 nt, Artificial Sequence
  Synthetic construct
uggaugcugaggucagaagga

SEQ ID NO: 3873 - RNA, 21 nt, Artificial Sequence
  Synthetic construct
acacaguacuugcucugguau

SEQ ID NO: 3874 - RNA, 21 nt, Artificial Sequence
  Synthetic construct
uuaucaaaucuugguacaaag

SEQ ID NO: 3875 - RNA, 21 nt, Artificial Sequence
  Synthetic construct
auaaauagauauauggugaaa

SEQ ID NO: 3876 - RNA, 21 nt, Artificial Sequence
  Synthetic construct
cuucuucuuccucuucaucuu

SEQ ID NO: 3877 - RNA, 21 nt, Artificial Sequence
  Synthetic construct
ugcuucaaauuaauauuaccg

SEQ ID NO: 3878 - RNA, 21 nt, Artificial Sequence
  Synthetic construct
auauacauaacucuccaauac

SEQ ID NO: 3879 - RNA, 21 nt, Artificial Sequence
  Synthetic construct
uaauuccaccacccuaacaca

SEQ ID NO: 3880 - RNA, 21 nt, Artificial Sequence
  Synthetic construct
aaggcaauaucugcaacagau

SEQ ID NO: 3881 - RNA, 21 nt, Artificial Sequence
  Synthetic construct
uguuuaaugauuucaaaguca

SEQ ID NO: 3882 - RNA, 21 nt, Artificial Sequence
  Synthetic construct
ugauguaaagcucauguauuu

SEQ ID NO: 3883 - RNA, 21 nt, Artificial Sequence
  Synthetic construct
auaccaucagcaggucuacaa

SEQ ID NO: 3884 - RNA, 21 nt, Artificial Sequence
  Synthetic construct
ugacacacacacgagaucagc

SEQ ID NO: 3885 - RNA, 21 nt, Artificial Sequence
  Synthetic construct
cuucuuucuaauacuuauuag

SEQ ID NO: 3886 - RNA, 21 nt, Artificial Sequence
  Synthetic construct
aauuugagaacaucuagaaca

SEQ ID NO: 3887 - RNA, 21 nt, Artificial Sequence
  Synthetic construct
agcaggaugucacaguuucag

SEQ ID NO: 3888 - RNA, 21 nt, Artificial Sequence
  Synthetic construct
cacgagaucagcaagaacgaa

SEQ ID NO: 3889 - RNA, 21 nt, Artificial Sequence
  Synthetic construct
ucuuguucagagcucagagac

SEQ ID NO: 3890 - RNA, 21 nt, Artificial Sequence
  Synthetic construct
uucucacccuucccugacuuu

SEQ ID NO: 3891 - RNA, 21 nt, Artificial Sequence
  Synthetic construct
cugaauauuaacugcaaguag

SEQ ID NO: 3892 - RNA, 21 nt, Artificial Sequence
  Synthetic construct
aauguacauaaguucuguuua

SEQ ID NO: 3893 - RNA, 21 nt, Artificial Sequence
  Synthetic construct
uacuuugcucaggagugaucu

SEQ ID NO: 3894 - RNA, 21 nt, Artificial Sequence
  Synthetic construct
ugggcgcucuuucuccuucuu

SEQ ID NO: 3895 - RNA, 21 nt, Artificial Sequence
  Synthetic construct
ucccaguuuacccucuuucca

SEQ ID NO: 3896 - RNA, 21 nt, Artificial Sequence
  Synthetic construct
cacaacuacugcaaacaaccu

SEQ ID NO: 3897 - RNA, 21 nt, Artificial Sequence
  Synthetic construct
ugcagucuuagcggcugcugu

SEQ ID NO: 3898 - RNA, 21 nt, Artificial Sequence
  Synthetic construct
acugaauauuaacugcaagua

SEQ ID NO: 3899 - RNA, 21 nt, Artificial Sequence
  Synthetic construct
ucacuucaaaucccaggccca

SEQ ID NO: 3900 - RNA, 21 nt, Artificial Sequence
  Synthetic construct
agggauagauguaaggaucag

SEQ ID NO: 3901 - RNA, 21 nt, Artificial Sequence
  Synthetic construct
uuggaguaaucgugcccauug

SEQ ID NO: 3902 - RNA, 21 nt, Artificial Sequence
  Synthetic construct
ucugaauaacauaaagaauaa

SEQ ID NO: 3903 - RNA, 21 nt, Artificial Sequence
  Synthetic construct
ugagcaaaggaauauaauuau

SEQ ID NO: 3904 - RNA, 21 nt, Artificial Sequence
  Synthetic construct
ugaggugacuaccucauuauu

SEQ ID NO: 3905 - RNA, 21 nt, Artificial Sequence
  Synthetic construct
agagacaguccuacauauuug

SEQ ID NO: 3906 - RNA, 21 nt, Artificial Sequence
  Synthetic construct
uuucuccuaugaggauuuccu

SEQ ID NO: 3907 - RNA, 21 nt, Artificial Sequence
  Synthetic construct
uguucagagcucagagacugg

SEQ ID NO: 3908 - RNA, 21 nt, Artificial Sequence
  Synthetic construct
uguauaaacaguaccugaugc

SEQ ID NO: 3909 - RNA, 21 nt, Artificial Sequence
  Synthetic construct
uguuaugaguauaaucccagu

SEQ ID NO: 3910 - RNA, 21 nt, Artificial Sequence
  Synthetic construct
ugacuacccauaguucaucac

SEQ ID NO: 3911 - RNA, 21 nt, Artificial Sequence
  Synthetic construct
ucucagcucaccacaaccucc

SEQ ID NO: 3912 - RNA, 21 nt, Artificial Sequence
  Synthetic construct
uuuagguccaaguuucaaacu

SEQ ID NO: 3913 - RNA, 21 nt, Artificial Sequence
  Synthetic construct
agagaaagucccaucuuuguu

SEQ ID NO: 3914 - RNA, 21 nt, Artificial Sequence
  Synthetic construct
aaaguuacagaagaauuucac

SEQ ID NO: 3915 - RNA, 21 nt, Artificial Sequence
  Synthetic construct
uccucaguggaggagccgggg

SEQ ID NO: 3916 - RNA, 21 nt, Artificial Sequence
  Synthetic construct
auaaagcucauauuagacucc

SEQ ID NO: 3917 - RNA, 21 nt, Artificial Sequence
  Synthetic construct
uaucaaaucuugguacaaagu

SEQ ID NO: 3918 - RNA, 21 nt, Artificial Sequence
  Synthetic construct
uuauuaaaguucucaccuaaa

SEQ ID NO: 3919 - RNA, 21 nt, Artificial Sequence
  Synthetic construct
ucaguccucuuguucagagcu

SEQ ID NO: 3920 - RNA, 21 nt, Artificial Sequence
  Synthetic construct
ucaccugguuugagugcagga

SEQ ID NO: 3921 - RNA, 21 nt, Artificial Sequence
  Synthetic construct
caucuucuucuucagacacag

SEQ ID NO: 3922 - RNA, 21 nt, Artificial Sequence
  Synthetic construct
uucccugacuuucccacugcc

SEQ ID NO: 3923 - RNA, 21 nt, Artificial Sequence
  Synthetic construct
gaaucguaugcucaaagucug

SEQ ID NO: 3924 - RNA, 21 nt, Artificial Sequence
  Synthetic construct
ucaagcgauucucccaccuca

SEQ ID NO: 3925 - RNA, 21 nt, Artificial Sequence
  Synthetic construct
acagucacuaauguacugauu

SEQ ID NO: 3926 - RNA, 21 nt, Artificial Sequence
  Synthetic construct
uaaccaacagaaagauuauau

SEQ ID NO: 3927 - RNA, 21 nt, Artificial Sequence
  Synthetic construct
guucacucuuagcagucucag

SEQ ID NO: 3928 - RNA, 21 nt, Artificial Sequence
  Synthetic construct
aacauaguaugcuucaaauua

SEQ ID NO: 3929 - RNA, 21 nt, Artificial Sequence
  Synthetic construct
aagccuucuauaacacaaauu

SEQ ID NO: 3930 - RNA, 21 nt, Artificial Sequence
  Synthetic construct
auguuggguuauauucauuug

SEQ ID NO: 3931 - RNA, 21 nt, Artificial Sequence
  Synthetic construct
aaaggagaagcucaaguacag

SEQ ID NO: 3932 - RNA, 21 nt, Artificial Sequence
  Synthetic construct
cuucuucuucagacacaggag

SEQ ID NO: 3933 - RNA, 21 nt, Artificial Sequence
  Synthetic construct
cuuccucuucaucuucuucuu

SEQ ID NO: 3934 - RNA, 21 nt, Artificial Sequence
  Synthetic construct
aacagaaauaggugauacaua

SEQ ID NO: 3935 - RNA, 21 nt, Artificial Sequence
  Synthetic construct
ucacaggaaaggagaagcuca

SEQ ID NO: 3936 - RNA, 21 nt, Artificial Sequence
  Synthetic construct
uaacuaaugaauagggcuucc

SEQ ID NO: 3937 - RNA, 21 nt, Artificial Sequence
  Synthetic construct
auccuuugguuagauggucuc

SEQ ID NO: 3938 - RNA, 21 nt, Artificial Sequence
  Synthetic construct
ucccauuucuuacagaguuga

SEQ ID NO: 3939 - RNA, 21 nt, Artificial Sequence
  Synthetic construct
agugguaguaaagaaguaccu

SEQ ID NO: 3940 - RNA, 21 nt, Artificial Sequence
  Synthetic construct
auuucaguccucuuguucaga

SEQ ID NO: 3941 - RNA, 21 nt, Artificial Sequence
  Synthetic construct
ugggauguagccuucacugac

SEQ ID NO: 3942 - RNA, 21 nt, Artificial Sequence
  Synthetic construct
auaccuuugcuuaacugaaua

SEQ ID NO: 3943 - RNA, 21 nt, Artificial Sequence
  Synthetic construct
cacucuuagcagucucagcca

SEQ ID NO: 3944 - RNA, 21 nt, Artificial Sequence
  Synthetic construct
cuucauuauccagaccgucag

SEQ ID NO: 3945 - RNA, 21 nt, Artificial Sequence
  Synthetic construct
auauuaaacacauucccaaug

SEQ ID NO: 3946 - RNA, 21 nt, Artificial Sequence
  Synthetic construct
acucuuguugccgaggcugga

SEQ ID NO: 3947 - RNA, 21 nt, Artificial Sequence
  Synthetic construct
gacucauucucuacuaucgcu

SEQ ID NO: 3948 - RNA, 21 nt, Artificial Sequence
  Synthetic construct
cuauggaauaauuguaacuag

SEQ ID NO: 3949 - RNA, 21 nt, Artificial Sequence
  Synthetic construct
ucguaugcucaaagucugaag

SEQ ID NO: 3950 - RNA, 21 nt, Artificial Sequence
  Synthetic construct
aucuuuccugcagcagaguuu

SEQ ID NO: 3951 - RNA, 21 nt, Artificial Sequence
  Synthetic construct
augcaagagggacuacucucu

SEQ ID NO: 3952 - RNA, 21 nt, Artificial Sequence
  Synthetic construct
cuucuucuucuuccucuucau

SEQ ID NO: 3953 - RNA, 21 nt, Artificial Sequence
  Synthetic construct
uaauaaagcucauauuagacu

SEQ ID NO: 3954 - RNA, 21 nt, Artificial Sequence
  Synthetic construct
ugagaauuaaacucuagaaag

SEQ ID NO: 3955 - RNA, 21 nt, Artificial Sequence
  Synthetic construct
aagagggagugugcaucuuug

SEQ ID NO: 3956 - RNA, 21 nt, Artificial Sequence
  Synthetic construct
augauuaauguaucuauuucc

SEQ ID NO: 3957 - RNA, 21 nt, Artificial Sequence
  Synthetic construct
uauuugcggguccauaaagca

SEQ ID NO: 3958 - RNA, 21 nt, Artificial Sequence
  Synthetic construct
aacuuguaaguguuuagguuc

SEQ ID NO: 3959 - RNA, 21 nt, Artificial Sequence
  Synthetic construct
uuguaaguguuuagguucacu

SEQ ID NO: 3960 - RNA, 21 nt, Artificial Sequence
  Synthetic construct
cucuuggguacuaaaucuguu

SEQ ID NO: 3961 - RNA, 21 nt, Artificial Sequence
  Synthetic construct
guuaagugacuugccuagcgu

SEQ ID NO: 3962 - RNA, 21 nt, Artificial Sequence
  Synthetic construct
aaggagaagcucaaguacagu

SEQ ID NO: 3963 - RNA, 21 nt, Artificial Sequence
  Synthetic construct
auacaauucugauaaacaaug

SEQ ID NO: 3964 - RNA, 21 nt, Artificial Sequence
  Synthetic construct
aaagcacaccacacacaagca

SEQ ID NO: 3965 - RNA, 21 nt, Artificial Sequence
  Synthetic construct
accacuuuauggucacuucaa

SEQ ID NO: 3966 - RNA, 21 nt, Artificial Sequence
  Synthetic construct
agucuccuaagaaagcgugug

SEQ ID NO: 3967 - RNA, 21 nt, Artificial Sequence
  Synthetic construct
aagugcugggauuacagguau

SEQ ID NO: 3968 - RNA, 21 nt, Artificial Sequence
  Synthetic construct
cagucaauuuaacagagccau

SEQ ID NO: 3969 - RNA, 21 nt, Artificial Sequence
  Synthetic construct
uauccacauccaucucaagac

SEQ ID NO: 3970 - RNA, 21 nt, Artificial Sequence
  Synthetic construct
agucauauaaggaauucuguc

SEQ ID NO: 3971 - RNA, 21 nt, Artificial Sequence
  Synthetic construct
acaagccugaaagaaaucuga

SEQ ID NO: 3972 - RNA, 21 nt, Artificial Sequence
  Synthetic construct
acauauuccucuccacuuuug

SEQ ID NO: 3973 - RNA, 21 nt, Artificial Sequence
  Synthetic construct
acugcuggugaagcaauggau

SEQ ID NO: 3974 - RNA, 21 nt, Artificial Sequence
  Synthetic construct
gugucuauaguucccuuucug

SEQ ID NO: 3975 - RNA, 21 nt, Artificial Sequence
  Synthetic construct
uucuugggauaugauuguaag

SEQ ID NO: 3976 - RNA, 21 nt, Artificial Sequence
  Synthetic construct
acuaagcagcauaucugaggu

SEQ ID NO: 3977 - RNA, 21 nt, Artificial Sequence
  Synthetic construct
aaugcaagagggacuacucuc

SEQ ID NO: 3978 - RNA, 21 nt, Artificial Sequence
  Synthetic construct
uucuuucauaggagaaauauu

SEQ ID NO: 3979 - RNA, 21 nt, Artificial Sequence
  Synthetic construct
gacaacaggaagcaauuucgu

SEQ ID NO: 3980 - RNA, 21 nt, Artificial Sequence
  Synthetic construct
uuucaguauucuacauuuauc

SEQ ID NO: 3981 - RNA, 21 nt, Artificial Sequence
  Synthetic construct
uuugcaaggcaaccuauaaug

SEQ ID NO: 3982 - RNA, 21 nt, Artificial Sequence
  Synthetic construct
ucaggcuuaaacgugauauuu

SEQ ID NO: 3983 - RNA, 21 nt, Artificial Sequence
  Synthetic construct
guaaucgugcccauugcucug

SEQ ID NO: 3984 - RNA, 21 nt, Artificial Sequence
  Synthetic construct
aguuauacagacaacaggaag

SEQ ID NO: 3985 - RNA, 21 nt, Artificial Sequence
  Synthetic construct
acagaacccaaagucagucaa

SEQ ID NO: 3986 - RNA, 21 nt, Artificial Sequence
  Synthetic construct
gaaacucuaaagaaagugcuu

SEQ ID NO: 3987 - RNA, 21 nt, Artificial Sequence
  Synthetic construct
uccuguacaaaguacuggaau

SEQ ID NO: 3988 - RNA, 21 nt, Artificial Sequence
  Synthetic construct
ucauagaauuugagaacaucu

SEQ ID NO: 3989 - RNA, 21 nt, Artificial Sequence
  Synthetic construct
auuaucaaaucuugguacaaa

SEQ ID NO: 3990 - RNA, 21 nt, Artificial Sequence
  Synthetic construct
uuacaaauaaauuacauaauc

SEQ ID NO: 3991 - RNA, 21 nt, Artificial Sequence
  Synthetic construct
ugaauaugguauuugcggguc

SEQ ID NO: 3992 - RNA, 21 nt, Artificial Sequence
  Synthetic construct
acuuauuagaaauauacauaa

SEQ ID NO: 3993 - RNA, 21 nt, Artificial Sequence
  Synthetic construct
cauuuauagacaaauaucuca

SEQ ID NO: 3994 - RNA, 21 nt, Artificial Sequence
  Synthetic construct
aauauugucacucuuuauauc

SEQ ID NO: 3995 - RNA, 21 nt, Artificial Sequence
  Synthetic construct
uggacuuccacauguucacac

SEQ ID NO: 3996 - RNA, 21 nt, Artificial Sequence
  Synthetic construct
acauaaagaauaaauacuuga

SEQ ID NO: 3997 - RNA, 21 nt, Artificial Sequence
  Synthetic construct
agcuaucuaaauaauuaacaa

SEQ ID NO: 3998 - RNA, 21 nt, Artificial Sequence
  Synthetic construct
acaaauauuuacaaugacaca

SEQ ID NO: 3999 - RNA, 21 nt, Artificial Sequence
  Synthetic construct
guuguugacuguuucuuugga

SEQ ID NO: 4000 - RNA, 21 nt, Artificial Sequence
  Synthetic construct
aggcuggucucgaacuccuga

SEQ ID NO: 4001 - RNA, 21 nt, Artificial Sequence
  Synthetic construct
cuguugcaaugucuagugcug

SEQ ID NO: 4002 - RNA, 21 nt, Artificial Sequence
  Synthetic construct
uugcuucaaccacaauuuaaa

SEQ ID NO: 4003 - RNA, 21 nt, Artificial Sequence
  Synthetic construct
auucacauaauuccaccaccc

SEQ ID NO: 4004 - RNA, 21 nt, Artificial Sequence
  Synthetic construct
uugggaccauccacuaacucc

SEQ ID NO: 4005 - RNA, 21 nt, Artificial Sequence
  Synthetic construct
uccucuuguucagagcucaga

SEQ ID NO: 4006 - RNA, 21 nt, Artificial Sequence
  Synthetic construct
agacgaaguuucacucuuguu

SEQ ID NO: 4007 - RNA, 21 nt, Artificial Sequence
  Synthetic construct
caauacuuuagguccaaguuu

SEQ ID NO: 4008 - RNA, 21 nt, Artificial Sequence
  Synthetic construct
ugcucaggagugaucugggca

SEQ ID NO: 4009 - RNA, 21 nt, Artificial Sequence
  Synthetic construct
caagagaccagauaucaacuu

SEQ ID NO: 4010 - RNA, 21 nt, Artificial Sequence
  Synthetic construct
cuguccuucauccauacaggu

SEQ ID NO: 4011 - RNA, 21 nt, Artificial Sequence
  Synthetic construct
uaauacuuauuagaaauauac

SEQ ID NO: 4012 - RNA, 21 nt, Artificial Sequence
  Synthetic construct
uaauuccaagagaccagauau

SEQ ID NO: 4013 - RNA, 21 nt, Artificial Sequence
  Synthetic construct
uuuccuucccaguccacaugc

SEQ ID NO: 4014 - RNA, 21 nt, Artificial Sequence
  Synthetic construct
uaaucugagggaguaggaaaa

SEQ ID NO: 4015 - RNA, 21 nt, Artificial Sequence
  Synthetic construct
uuggguugcuguugaagguuc

SEQ ID NO: 4016 - RNA, 21 nt, Artificial Sequence
  Synthetic construct
agauauauggugaaauaguag

SEQ ID NO: 4017 - RNA, 21 nt, Artificial Sequence
  Synthetic construct
aggauuucaguauucuacauu

SEQ ID NO: 4018 - RNA, 21 nt, Artificial Sequence
  Synthetic construct
caauauuauaacaauaucaaa

SEQ ID NO: 4019 - RNA, 21 nt, Artificial Sequence
  Synthetic construct
guuuagguucacucuuagcag

SEQ ID NO: 4020 - RNA, 21 nt, Artificial Sequence
  Synthetic construct
ucuagaacagcuuguggguuc

SEQ ID NO: 4021 - RNA, 21 nt, Artificial Sequence
  Synthetic construct
uauaaggaauucugucggacu

SEQ ID NO: 4022 - RNA, 21 nt, Artificial Sequence
  Synthetic construct
auggaggugauaucucaguuc

SEQ ID NO: 4023 - RNA, 21 nt, Artificial Sequence
  Synthetic construct
acuaugaagagggagugugca

SEQ ID NO: 4024 - RNA, 21 nt, Artificial Sequence
  Synthetic construct
ugugguugagugcugaagaau

SEQ ID NO: 4025 - RNA, 21 nt, Artificial Sequence
  Synthetic construct
aaacacauucccaaugcaugu

SEQ ID NO: 4026 - RNA, 21 nt, Artificial Sequence
  Synthetic construct
uaucuuugguucccaacaaau

SEQ ID NO: 4027 - RNA, 21 nt, Artificial Sequence
  Synthetic construct
aagccuauggaauaauuguaa

SEQ ID NO: 4028 - RNA, 21 nt, Artificial Sequence
  Synthetic construct
aaugacacacacacgagauca

SEQ ID NO: 4029 - RNA, 21 nt, Artificial Sequence
  Synthetic construct
cuuccaucuuuccugcagcag

SEQ ID NO: 4030 - RNA, 21 nt, Artificial Sequence
  Synthetic construct
auaaauacuugaguuaaaucu

SEQ ID NO: 4031 - RNA, 21 nt, Artificial Sequence
  Synthetic construct
uccuucuuccuaggcuaguau

SEQ ID NO: 4032 - RNA, 21 nt, Artificial Sequence
  Synthetic construct
ucauuauccagaccgucagac

SEQ ID NO: 4033 - RNA, 21 nt, Artificial Sequence
  Synthetic construct
ugggauagcauuugccugaug

SEQ ID NO: 4034 - RNA, 21 nt, Artificial Sequence
  Synthetic construct
uccuuugcagcgauaaucaga

SEQ ID NO: 4035 - RNA, 21 nt, Artificial Sequence
  Synthetic construct
uuuauaucucuauggaucacc

SEQ ID NO: 4036 - RNA, 21 nt, Artificial Sequence
  Synthetic construct
gaaguuucacucuuguugccg

SEQ ID NO: 4037 - RNA, 21 nt, Artificial Sequence
  Synthetic construct
caucuuuguuuaaaugugguu

SEQ ID NO: 4038 - RNA, 21 nt, Artificial Sequence
  Synthetic construct
acacuaugaagagggagugug

SEQ ID NO: 4039 - RNA, 21 nt, Artificial Sequence
  Synthetic construct
augcacaauccauauuucaau

SEQ ID NO: 4040 - RNA, 21 nt, Artificial Sequence
  Synthetic construct
cuguucuuaauugcuuccuuu

SEQ ID NO: 4041 - RNA, 21 nt, Artificial Sequence
  Synthetic construct
cuuugcucaggagugaucugg

SEQ ID NO: 4042 - RNA, 21 nt, Artificial Sequence
  Synthetic construct
uacaggauucugugaagaucu

SEQ ID NO: 4043 - RNA, 21 nt, Artificial Sequence
  Synthetic construct
aaauaccuuuaauccaaaguu

SEQ ID NO: 4044 - RNA, 21 nt, Artificial Sequence
  Synthetic construct
agcucauauuagacuccgggg

SEQ ID NO: 4045 - RNA, 21 nt, Artificial Sequence
  Synthetic construct
aacugcaaguagcuuagauaa

SEQ ID NO: 4046 - RNA, 21 nt, Artificial Sequence
  Synthetic construct
aacaacuuucuguaauuuaca

SEQ ID NO: 4047 - RNA, 21 nt, Artificial Sequence
  Synthetic construct
uaacaacauuaacguucuuuc

SEQ ID NO: 4048 - RNA, 21 nt, Artificial Sequence
  Synthetic construct
cauggugacugauuugagggg

SEQ ID NO: 4049 - RNA, 21 nt, Artificial Sequence
  Synthetic construct
uuugcggguccauaaagcaca

SEQ ID NO: 4050 - RNA, 21 nt, Artificial Sequence
  Synthetic construct
agugcuguauaaacaguaccu

SEQ ID NO: 4051 - RNA, 21 nt, Artificial Sequence
  Synthetic construct
ugaaggagguuugaaugcaag

SEQ ID NO: 4052 - RNA, 21 nt, Artificial Sequence
  Synthetic construct
uugcuuccuuugcagcgauaa

SEQ ID NO: 4053 - RNA, 21 nt, Artificial Sequence
  Synthetic construct
ucucuacuaucgcuguugauu

SEQ ID NO: 4054 - RNA, 21 nt, Artificial Sequence
  Synthetic construct
auaggugauacauaggaaaaa

SEQ ID NO: 4055 - RNA, 21 nt, Artificial Sequence
  Synthetic construct
auucaaccugagagucuguua

SEQ ID NO: 4056 - RNA, 21 nt, Artificial Sequence
  Synthetic construct
auucugucggacugacauuuc

SEQ ID NO: 4057 - RNA, 21 nt, Artificial Sequence
  Synthetic construct
guagacaucacuacccuguga

SEQ ID NO: 4058 - RNA, 21 nt, Artificial Sequence
  Synthetic construct
agauggucucccuugcucuuu

SEQ ID NO: 4059 - RNA, 21 nt, Artificial Sequence
  Synthetic construct
ucccaccauagugcuucguuu

SEQ ID NO: 4060 - RNA, 21 nt, Artificial Sequence
  Synthetic construct
uguaccaaaugugaauccuuc

SEQ ID NO: 4061 - RNA, 21 nt, Artificial Sequence
  Synthetic construct
ugguauuaugggauagcauuu

SEQ ID NO: 4062 - RNA, 21 nt, Artificial Sequence
  Synthetic construct
aauauuaggguucuuauuuuc

SEQ ID NO: 4063 - RNA, 21 nt, Artificial Sequence
  Synthetic construct
ucaggcuggagagaggcuugg

SEQ ID NO: 4064 - RNA, 21 nt, Artificial Sequence
  Synthetic construct
guagcuacaggauucugugaa

SEQ ID NO: 4065 - RNA, 21 nt, Artificial Sequence
  Synthetic construct
ucuccuaagaaagcgugugcc

SEQ ID NO: 4066 - RNA, 21 nt, Artificial Sequence
  Synthetic construct
cacucuuuauaucucuaugga

SEQ ID NO: 4067 - RNA, 21 nt, Artificial Sequence
  Synthetic construct
acaaccuccgccuccuggguu

SEQ ID NO: 4068 - RNA, 21 nt, Artificial Sequence
  Synthetic construct
ugaccucccauuucuuacaga

SEQ ID NO: 4069 - RNA, 21 nt, Artificial Sequence
  Synthetic construct
acaacgcacuggauccuugcu

SEQ ID NO: 4070 - RNA, 21 nt, Artificial Sequence
  Synthetic construct
uaugguauuugcggguccaua

SEQ ID NO: 4071 - RNA, 21 nt, Artificial Sequence
  Synthetic construct
cuuggugcgauaacugguggu

SEQ ID NO: 4072 - RNA, 21 nt, Artificial Sequence
  Synthetic construct
cucuucauuauccagaccguc

SEQ ID NO: 4073 - RNA, 21 nt, Artificial Sequence
  Synthetic construct
cuccucaucugucaucuugga

SEQ ID NO: 4074 - RNA, 21 nt, Artificial Sequence
  Synthetic construct
ucuuuccugcagcagaguuuu

SEQ ID NO: 4075 - RNA, 21 nt, Artificial Sequence
  Synthetic construct
uaucaucaauaaugaauaugg

SEQ ID NO: 4076 - RNA, 21 nt, Artificial Sequence
  Synthetic construct
acacuagcaacaucaaagauu

SEQ ID NO: 4077 - RNA, 21 nt, Artificial Sequence
  Synthetic construct
cacacaguacuugcucuggua

SEQ ID NO: 4078 - RNA, 21 nt, Artificial Sequence
  Synthetic construct
auuccuaacucaggacauuuu

SEQ ID NO: 4079 - RNA, 21 nt, Artificial Sequence
  Synthetic construct
uccugaccucaggugauccgc

SEQ ID NO: 4080 - RNA, 21 nt, Artificial Sequence
  Synthetic construct
ucaaccacagaacgaguauag

SEQ ID NO: 4081 - RNA, 21 nt, Artificial Sequence
  Synthetic construct
acaaacacaacacuaugaaga

SEQ ID NO: 4082 - RNA, 21 nt, Artificial Sequence
  Synthetic construct
agauucaguuagacauuguuu

SEQ ID NO: 4083 - RNA, 21 nt, Artificial Sequence
  Synthetic construct
uccacuggagagaauuucaag

SEQ ID NO: 4084 - RNA, 21 nt, Artificial Sequence
  Synthetic construct
acuaacucccaguuuacccuc

SEQ ID NO: 4085 - RNA, 21 nt, Artificial Sequence
  Synthetic construct
cacacaggugugcacauggag

SEQ ID NO: 4086 - RNA, 21 nt, Artificial Sequence
  Synthetic construct
ccagacuuuacauacagacug

SEQ ID NO: 4087 - RNA, 21 nt, Artificial Sequence
  Synthetic construct
aucaccugguuugagugcagg

SEQ ID NO: 4088 - RNA, 21 nt, Artificial Sequence
  Synthetic construct
aaagaccaagagauucaaccg

SEQ ID NO: 4089 - RNA, 21 nt, Artificial Sequence
  Synthetic construct
cugcagacagcugcuaucugu

SEQ ID NO: 4090 - RNA, 21 nt, Artificial Sequence
  Synthetic construct
auuuccuccugguaugccuau

SEQ ID NO: 4091 - RNA, 21 nt, Artificial Sequence
  Synthetic construct
auguuucauaagcacaagaga

SEQ ID NO: 4092 - RNA, 21 nt, Artificial Sequence
  Synthetic construct
uucccaaugcauguuggguua

SEQ ID NO: 4093 - RNA, 21 nt, Artificial Sequence
  Synthetic construct
acauggacacacaaauauuua

SEQ ID NO: 4094 - RNA, 21 nt, Artificial Sequence
  Synthetic construct
gaacacacauauuccucucca

SEQ ID NO: 4095 - RNA, 21 nt, Artificial Sequence
  Synthetic construct
ucuuugagcugagaaauauca

SEQ ID NO: 4096 - RNA, 21 nt, Artificial Sequence
  Synthetic construct
agaagaauuucacuacacaug

SEQ ID NO: 4097 - RNA, 21 nt, Artificial Sequence
  Synthetic construct
uauccuguuggacaagaaaau

SEQ ID NO: 4098 - RNA, 21 nt, Artificial Sequence
  Synthetic construct
aggaagagagaucucugggcg

SEQ ID NO: 4099 - RNA, 21 nt, Artificial Sequence
  Synthetic construct
cagcugacagucucucaggau

SEQ ID NO: 4100 - RNA, 21 nt, Artificial Sequence
  Synthetic construct
ccuaaggaucaucuaguccaa

SEQ ID NO: 4101 - RNA, 21 nt, Artificial Sequence
  Synthetic construct
uguuaauaugcugaacugaaa

SEQ ID NO: 4102 - RNA, 21 nt, Artificial Sequence
  Synthetic construct
ucacccaccaaguagcuaucu

SEQ ID NO: 4103 - RNA, 21 nt, Artificial Sequence
  Synthetic construct
ucccaguagacaucacuaccc

SEQ ID NO: 4104 - RNA, 21 nt, Artificial Sequence
  Synthetic construct
auaagaaguuucuauucauuu

SEQ ID NO: 4105 - RNA, 21 nt, Artificial Sequence
  Synthetic construct
acagaacgaguauagauugau

SEQ ID NO: 4106 - RNA, 21 nt, Artificial Sequence
  Synthetic construct
augggcucugcuaucuugugc

SEQ ID NO: 4107 - RNA, 21 nt, Artificial Sequence
  Synthetic construct
cuaaggaucaucuaguccaau

SEQ ID NO: 4108 - RNA, 21 nt, Artificial Sequence
  Synthetic construct
uauuuccaaguucccauuuau

SEQ ID NO: 4109 - RNA, 21 nt, Artificial Sequence
  Synthetic construct
auccagaccgucagacauuuu

SEQ ID NO: 4110 - RNA, 21 nt, Artificial Sequence
  Synthetic construct
cauccaucucaagacagcgau

SEQ ID NO: 4111 - RNA, 21 nt, Artificial Sequence
  Synthetic construct
auuugcaucccaggauuucau

SEQ ID NO: 4112 - RNA, 21 nt, Artificial Sequence
  Synthetic construct
aucaauaaugaauaugguauu

SEQ ID NO: 4113 - RNA, 21 nt, Artificial Sequence
  Synthetic construct
uucauuugaaagguaaagaac

SEQ ID NO: 4114 - RNA, 21 nt, Artificial Sequence
  Synthetic construct
aucagaggagucaggcuggag

SEQ ID NO: 4115 - RNA, 21 nt, Artificial Sequence
  Synthetic construct
auggucucccuugcucuuuaa

SEQ ID NO: 4116 - RNA, 21 nt, Artificial Sequence
  Synthetic construct
uggugcgauaacugguggugg

SEQ ID NO: 4117 - RNA, 21 nt, Artificial Sequence
  Synthetic construct
acaaugcuucuuagcuucucu

SEQ ID NO: 4118 - RNA, 21 nt, Artificial Sequence
  Synthetic construct
aagcaugaacacaccauauuc

SEQ ID NO: 4119 - RNA, 21 nt, Artificial Sequence
  Synthetic construct
uaaggccucucucucucauua

SEQ ID NO: 4120 - RNA, 21 nt, Artificial Sequence
  Synthetic construct
ugcaaggcaaccuauaaugcc

SEQ ID NO: 4121 - RNA, 21 nt, Artificial Sequence
  Synthetic construct
uucauugaauuucccggcacu

SEQ ID NO: 4122 - RNA, 21 nt, Artificial Sequence
  Synthetic construct
aggcuugcagucuuagcggcu

SEQ ID NO: 4123 - RNA, 21 nt, Artificial Sequence
  Synthetic construct
aggaauauaauuauuuacacg

SEQ ID NO: 4124 - RNA, 21 nt, Artificial Sequence
  Synthetic construct
auucaaccacagaacgaguau

SEQ ID NO: 4125 - RNA, 21 nt, Artificial Sequence
  Synthetic construct
acagcuuguggguucuucuuc

SEQ ID NO: 4126 - RNA, 21 nt, Artificial Sequence
  Synthetic construct
cugcuaucuguccuucaucca

SEQ ID NO: 4127 - RNA, 21 nt, Artificial Sequence
  Synthetic construct
cugaacauaaacacguacacu

SEQ ID NO: 4128 - RNA, 21 nt, Artificial Sequence
  Synthetic construct
aauuccuucuuggguugcugu

SEQ ID NO: 4129 - RNA, 21 nt, Artificial Sequence
  Synthetic construct
ugaacacaccauauuccgaaa

SEQ ID NO: 4130 - RNA, 21 nt, Artificial Sequence
  Synthetic construct
aagucauaacuucuauugaaa

SEQ ID NO: 4131 - RNA, 21 nt, Artificial Sequence
  Synthetic construct
aucaacauugaaagaugugcc

SEQ ID NO: 4132 - RNA, 21 nt, Artificial Sequence
  Synthetic construct
aucauagaauuugagaacauc

SEQ ID NO: 4133 - RNA, 21 nt, Artificial Sequence
  Synthetic construct
gaacauaaacacguacacuau

SEQ ID NO: 4134 - RNA, 21 nt, Artificial Sequence
  Synthetic construct
uacugcugguauuaugggaua

SEQ ID NO: 4135 - RNA, 21 nt, Artificial Sequence
  Synthetic construct
uggugagguguaaggcuugca

SEQ ID NO: 4136 - RNA, 21 nt, Artificial Sequence
  Synthetic construct
gaauauaauuauuuacacgau

SEQ ID NO: 4137 - RNA, 21 nt, Artificial Sequence
  Synthetic construct
auagcaggcugaauuugcaag

SEQ ID NO: 4138 - RNA, 21 nt, Artificial Sequence
  Synthetic construct
gucggacugacauuucuuggg

SEQ ID NO: 4139 - RNA, 21 nt, Artificial Sequence
  Synthetic construct
cuugagaauuaaacucuagaa

SEQ ID NO: 4140 - RNA, 21 nt, Artificial Sequence
  Synthetic construct
agauggugagguguaaggcuu

SEQ ID NO: 4141 - RNA, 21 nt, Artificial Sequence
  Synthetic construct
auaacauaaagaauaaauacu

SEQ ID NO: 4142 - RNA, 21 nt, Artificial Sequence
  Synthetic construct
cacauggaggugauaucucag

SEQ ID NO: 4143 - RNA, 21 nt, Artificial Sequence
  Synthetic construct
ccauaguucaucacccaccaa

SEQ ID NO: 4144 - RNA, 21 nt, Artificial Sequence
  Synthetic construct
aagauguggauauauggaugg

SEQ ID NO: 4145 - RNA, 21 nt, Artificial Sequence
  Synthetic construct
uuagaaauaaacccauugagc

SEQ ID NO: 4146 - RNA, 21 nt, Artificial Sequence
  Synthetic construct
cagucucucaggauucuggag

SEQ ID NO: 4147 - RNA, 21 nt, Artificial Sequence
  Synthetic construct
cauagugcuucguuuacuuug

SEQ ID NO: 4148 - RNA, 21 nt, Artificial Sequence
  Synthetic construct
acacuauauaguuugcugaaa

SEQ ID NO: 4149 - RNA, 21 nt, Artificial Sequence
  Synthetic construct
uuucagguauuaaggagauua

SEQ ID NO: 4150 - RNA, 21 nt, Artificial Sequence
  Synthetic construct
aaugagauacaauucugauaa

SEQ ID NO: 4151 - RNA, 21 nt, Artificial Sequence
  Synthetic construct
gugacuucucuagguauaggg

SEQ ID NO: 4152 - RNA, 21 nt, Artificial Sequence
  Synthetic construct
cuggucucgaacuccugaccu

SEQ ID NO: 4153 - RNA, 21 nt, Artificial Sequence
  Synthetic construct
aguucuguuuagauucuuuua

SEQ ID NO: 4154 - RNA, 21 nt, Artificial Sequence
  Synthetic construct
ugcacauggaggugauaucuc

SEQ ID NO: 4155 - RNA, 21 nt, Artificial Sequence
  Synthetic construct
ugcuucuuagcuucucuaaga

SEQ ID NO: 4156 - RNA, 21 nt, Artificial Sequence
  Synthetic construct
uucagguauuaaggagauuaa

SEQ ID NO: 4157 - RNA, 21 nt, Artificial Sequence
  Synthetic construct
ucucccuagcuuuaacuuaua

SEQ ID NO: 4158 - RNA, 21 nt, Artificial Sequence
  Synthetic construct
auucuacauuuaucugguuuu

SEQ ID NO: 4159 - RNA, 21 nt, Artificial Sequence
  Synthetic construct
guccacaugcaaauacacguu

SEQ ID NO: 4160 - RNA, 21 nt, Artificial Sequence
  Synthetic construct
aacauuucucaaugcuaauag

SEQ ID NO: 4161 - RNA, 21 nt, Artificial Sequence
  Synthetic construct
auccacauccaucucaagaca

SEQ ID NO: 4162 - RNA, 21 nt, Artificial Sequence
  Synthetic construct
ugauuuccucuuggguacuaa

SEQ ID NO: 4163 - RNA, 21 nt, Artificial Sequence
  Synthetic construct
auaaucccaguagacaucacu

SEQ ID NO: 4164 - RNA, 21 nt, Artificial Sequence
  Synthetic construct
auauguuucauaagcacaaga

SEQ ID NO: 4165 - RNA, 21 nt, Artificial Sequence
  Synthetic construct
aguguuuagguucacucuuag

SEQ ID NO: 4166 - RNA, 21 nt, Artificial Sequence
  Synthetic construct
uauuaaacacauucccaaugc

SEQ ID NO: 4167 - RNA, 21 nt, Artificial Sequence
  Synthetic construct
gauuaugacaacgcacuggau

SEQ ID NO: 4168 - RNA, 21 nt, Artificial Sequence
  Synthetic construct
ucuggacaucuaaugacaaug

SEQ ID NO: 4169 - RNA, 21 nt, Artificial Sequence
  Synthetic construct
cuauaacacaaauuguuaguu

SEQ ID NO: 4170 - RNA, 21 nt, Artificial Sequence
  Synthetic construct
uggagcucuggaguuccauua

SEQ ID NO: 4171 - RNA, 21 nt, Artificial Sequence
  Synthetic construct
ugaacucaccuagcaggaugu

SEQ ID NO: 4172 - RNA, 21 nt, Artificial Sequence
  Synthetic construct
auggacuuccacauguucaca

SEQ ID NO: 4173 - RNA, 21 nt, Artificial Sequence
  Synthetic construct
ugccuacagugaucugaaggg

SEQ ID NO: 4174 - RNA, 21 nt, Artificial Sequence
  Synthetic construct
uguacauaaguucuguuuaga

SEQ ID NO: 4175 - RNA, 21 nt, Artificial Sequence
  Synthetic construct
aaauauuuacaaugacacaca

SEQ ID NO: 4176 - RNA, 21 nt, Artificial Sequence
  Synthetic construct
agcaauauuauaacaauauca

SEQ ID NO: 4177 - RNA, 21 nt, Artificial Sequence
  Synthetic construct
cacuacaucugacucauucuc

SEQ ID NO: 4178 - RNA, 21 nt, Artificial Sequence
  Synthetic construct
uucaaagugaaugcacaaaau

SEQ ID NO: 4179 - RNA, 21 nt, Artificial Sequence
  Synthetic construct
ucuauugaaauuagugggacu

SEQ ID NO: 4180 - RNA, 21 nt, Artificial Sequence
  Synthetic construct
acaucucccuagcuuuaacuu

SEQ ID NO: 4181 - RNA, 21 nt, Artificial Sequence
  Synthetic construct
auuaauuuagguaucauuauc

SEQ ID NO: 4182 - RNA, 21 nt, Artificial Sequence
  Synthetic construct
cucucucucucauuagagcag

SEQ ID NO: 4183 - RNA, 21 nt, Artificial Sequence
  Synthetic construct
ucaguucccgcauuugcagau

SEQ ID NO: 4184 - RNA, 21 nt, Artificial Sequence
  Synthetic construct
ugcaaugucuagugcuguaua

SEQ ID NO: 4185 - RNA, 21 nt, Artificial Sequence
  Synthetic construct
cuuugagcugagaaauaucau

SEQ ID NO: 4186 - RNA, 21 nt, Artificial Sequence
  Synthetic construct
aauaaauaaucucuacugugc

SEQ ID NO: 4187 - RNA, 21 nt, Artificial Sequence
  Synthetic construct
aguagcugggauuacaggcgc

SEQ ID NO: 4188 - RNA, 21 nt, Artificial Sequence
  Synthetic construct
aauguccaacaaggauuucag

SEQ ID NO: 4189 - RNA, 21 nt, Artificial Sequence
  Synthetic construct
auuucuuuggugaguuagaag

SEQ ID NO: 4190 - RNA, 21 nt, Artificial Sequence
  Synthetic construct
ucuuuauaucucuauggauca

SEQ ID NO: 4191 - RNA, 21 nt, Artificial Sequence
  Synthetic construct
uauuugcaauacuuuaggucc

SEQ ID NO: 4192 - RNA, 21 nt, Artificial Sequence
  Synthetic construct
agauacaaugcccugagugga

SEQ ID NO: 4193 - RNA, 21 nt, Artificial Sequence
  Synthetic construct
auuugcggguccauaaagcac

SEQ ID NO: 4194 - RNA, 21 nt, Artificial Sequence
  Synthetic construct
caaauaaauuacauaaucuga

SEQ ID NO: 4195 - RNA, 21 nt, Artificial Sequence
  Synthetic construct
uugcaaggcaaccuauaaugc

SEQ ID NO: 4196 - RNA, 21 nt, Artificial Sequence
  Synthetic construct
cugugaagaucuuaucaucaa

SEQ ID NO: 4197 - RNA, 21 nt, Artificial Sequence
  Synthetic construct
ucccuuucugcuguuuauuua

SEQ ID NO: 4198 - RNA, 21 nt, Artificial Sequence
  Synthetic construct
agagacugggagauacuugca

SEQ ID NO: 4199 - RNA, 21 nt, Artificial Sequence
  Synthetic construct
ugggcugcuauguauccaugu

SEQ ID NO: 4200 - RNA, 21 nt, Artificial Sequence
  Synthetic construct
ucauguauuucugguuguuga

SEQ ID NO: 4201 - RNA, 21 nt, Artificial Sequence
  Synthetic construct
aagugacuugccuagcgucac

SEQ ID NO: 4202 - RNA, 21 nt, Artificial Sequence
  Synthetic construct
gaaagcauaagagagaagcca

SEQ ID NO: 4203 - RNA, 21 nt, Artificial Sequence
  Synthetic construct
gaaauuagugggacuugcccu

SEQ ID NO: 4204 - RNA, 21 nt, Artificial Sequence
  Synthetic construct
gagagguuaagugacuugccu

SEQ ID NO: 4205 - RNA, 21 nt, Artificial Sequence
  Synthetic construct
cuaauagcauguaauuacuuu

SEQ ID NO: 4206 - RNA, 21 nt, Artificial Sequence
  Synthetic construct
ucuugggauaugauuguaagu

SEQ ID NO: 4207 - RNA, 21 nt, Artificial Sequence
  Synthetic construct
ugucuauaguucccuuucugc

SEQ ID NO: 4208 - RNA, 21 nt, Artificial Sequence
  Synthetic construct
ucaaacugucaguuuacaaau

SEQ ID NO: 4209 - RNA, 21 nt, Artificial Sequence
  Synthetic construct
auaauuccaagagaccagaua

SEQ ID NO: 4210 - RNA, 21 nt, Artificial Sequence
  Synthetic construct
agguucacucuuagcagucuc

SEQ ID NO: 4211 - RNA, 21 nt, Artificial Sequence
  Synthetic construct
cuacccauaguucaucaccca

SEQ ID NO: 4212 - RNA, 21 nt, Artificial Sequence
  Synthetic construct
cuuggguugcuguugaagguu

SEQ ID NO: 4213 - RNA, 21 nt, Artificial Sequence
  Synthetic construct
gaccagauaucaacuuucgga

SEQ ID NO: 4214 - RNA, 21 nt, Artificial Sequence
  Synthetic construct
aauaaucucuacugugcuucu

SEQ ID NO: 4215 - RNA, 21 nt, Artificial Sequence
  Synthetic construct
guuacaacuaauuucacagcu

SEQ ID NO: 4216 - RNA, 21 nt, Artificial Sequence
  Synthetic construct
gucacuucaacauugcugccc

SEQ ID NO: 4217 - RNA, 21 nt, Artificial Sequence
  Synthetic construct
cucauucucuacuaucgcugu

SEQ ID NO: 4218 - RNA, 21 nt, Artificial Sequence
  Synthetic construct
agugacaucucccuagcuuua

SEQ ID NO: 4219 - RNA, 21 nt, Artificial Sequence
  Synthetic construct
uuuggugaguuagaaggaagu

SEQ ID NO: 4220 - RNA, 21 nt, Artificial Sequence
  Synthetic construct
cuuuauuuagauauacaguuu

SEQ ID NO: 4221 - RNA, 21 nt, Artificial Sequence
  Synthetic construct
uacugugcuucucacccuucc

SEQ ID NO: 4222 - RNA, 21 nt, Artificial Sequence
  Synthetic construct
uaaggaucaucuaguccaaua

SEQ ID NO: 4223 - RNA, 21 nt, Artificial Sequence
  Synthetic construct
cauucucuacuaucgcuguug

SEQ ID NO: 4224 - RNA, 21 nt, Artificial Sequence
  Synthetic construct
ugcagacagcugcuaucuguc

SEQ ID NO: 4225 - RNA, 21 nt, Artificial Sequence
  Synthetic construct
caucacuacccugugaucugg

SEQ ID NO: 4226 - RNA, 21 nt, Artificial Sequence
  Synthetic construct
cucuuuauuugguacugcugg

SEQ ID NO: 4227 - RNA, 21 nt, Artificial Sequence
  Synthetic construct
acauucccaaugcauguuggg

SEQ ID NO: 4228 - RNA, 21 nt, Artificial Sequence
  Synthetic construct
ugcugggauuacagguaugag

SEQ ID NO: 4229 - RNA, 21 nt, Artificial Sequence
  Synthetic construct
acaugguuuacagauaacaca

SEQ ID NO: 4230 - RNA, 21 nt, Artificial Sequence
  Synthetic construct
uuaauaugcugaacugaaagc

SEQ ID NO: 4231 - RNA, 21 nt, Artificial Sequence
  Synthetic construct
guacuaaaucuguugaacaug

SEQ ID NO: 4232 - RNA, 21 nt, Artificial Sequence
  Synthetic construct
aaggaauucugucggacugac

SEQ ID NO: 4233 - RNA, 21 nt, Artificial Sequence
  Synthetic construct
acagcugcuaucuguccuuca

SEQ ID NO: 4234 - RNA, 21 nt, Artificial Sequence
  Synthetic construct
gucaucagaaaugcuaucuuu

SEQ ID NO: 4235 - RNA, 21 nt, Artificial Sequence
  Synthetic construct
cugguuuacucaauuaucuuu

SEQ ID NO: 4236 - RNA, 21 nt, Artificial Sequence
  Synthetic construct
aaauuaauuugucaacauuuc

SEQ ID NO: 4237 - RNA, 21 nt, Artificial Sequence
  Synthetic construct
acauaguaugcuucaaauuaa

SEQ ID NO: 4238 - RNA, 21 nt, Artificial Sequence
  Synthetic construct
cauuguuaauaugcugaacug

SEQ ID NO: 4239 - RNA, 21 nt, Artificial Sequence
  Synthetic construct
auggaggcucagaugcuguuu

SEQ ID NO: 4240 - RNA, 21 nt, Artificial Sequence
  Synthetic construct
caaagugguaguaaagaagua

SEQ ID NO: 4241 - RNA, 21 nt, Artificial Sequence
  Synthetic construct
uuuccuccugguaugccuauu

SEQ ID NO: 4242 - RNA, 21 nt, Artificial Sequence
  Synthetic construct
aacucuagaaagcccagcacu

SEQ ID NO: 4243 - RNA, 21 nt, Artificial Sequence
  Synthetic construct
ucaccacaaccuccgccuccu

SEQ ID NO: 4244 - RNA, 21 nt, Artificial Sequence
  Synthetic construct
auuuaacugcaacauaagaga

SEQ ID NO: 4245 - RNA, 21 nt, Artificial Sequence
  Synthetic construct
uuauuuccuucccaguccaca

SEQ ID NO: 4246 - RNA, 21 nt, Artificial Sequence
  Synthetic construct
gugaucugaagggucacugcu

SEQ ID NO: 4247 - RNA, 21 nt, Artificial Sequence
  Synthetic construct
ucacuauagcaggcugaauuu

SEQ ID NO: 4248 - RNA, 21 nt, Artificial Sequence
  Synthetic construct
auguauuucugguuguugacu

SEQ ID NO: 4249 - RNA, 21 nt, Artificial Sequence
  Synthetic construct
aauacuuuagguccaaguuuc

SEQ ID NO: 4250 - RNA, 21 nt, Artificial Sequence
  Synthetic construct
cuaagcaugaacacaccauau

SEQ ID NO: 4251 - RNA, 21 nt, Artificial Sequence
  Synthetic construct
auggaucaccugguuugagug

SEQ ID NO: 4252 - RNA, 21 nt, Artificial Sequence
  Synthetic construct
uuuguuuaaugauuucaaagu

SEQ ID NO: 4253 - RNA, 21 nt, Artificial Sequence
  Synthetic construct
aucucuacugugcuucucacc

SEQ ID NO: 4254 - RNA, 21 nt, Artificial Sequence
  Synthetic construct
aagaucuccucaucugucauc

SEQ ID NO: 4255 - RNA, 21 nt, Artificial Sequence
  Synthetic construct
caaacaaccuauaaauaggca

SEQ ID NO: 4256 - RNA, 21 nt, Artificial Sequence
  Synthetic construct
auuaugacaacgcacuggauc

SEQ ID NO: 4257 - RNA, 21 nt, Artificial Sequence
  Synthetic construct
acauguaagggaugcuaacua

SEQ ID NO: 4258 - RNA, 21 nt, Artificial Sequence
  Synthetic construct
gaaauauuccauuauuuccaa

SEQ ID NO: 4259 - RNA, 21 nt, Artificial Sequence
  Synthetic construct
auucuuucauaggagaaauau

SEQ ID NO: 4260 - RNA, 21 nt, Artificial Sequence
  Synthetic construct
ccagucuuuguccauaugcau

SEQ ID NO: 4261 - RNA, 21 nt, Artificial Sequence
  Synthetic construct
ucugacucauucucuacuauc

SEQ ID NO: 4262 - RNA, 21 nt, Artificial Sequence
  Synthetic construct
aacaucaaagauuuggauaga

SEQ ID NO: 4263 - RNA, 21 nt, Artificial Sequence
  Synthetic construct
cacaaugcuucuuagcuucuc

SEQ ID NO: 4264 - RNA, 21 nt, Artificial Sequence
  Synthetic construct
cagauaucaacuuucggacca

SEQ ID NO: 4265 - RNA, 21 nt, Artificial Sequence
  Synthetic construct
auaucugcaacagauguuauc

SEQ ID NO: 4266 - RNA, 21 nt, Artificial Sequence
  Synthetic construct
aggccuauguaacugaucucu

SEQ ID NO: 4267 - RNA, 21 nt, Artificial Sequence
  Synthetic construct
uccuuugguuagauggucucc

SEQ ID NO: 4268 - RNA, 21 nt, Artificial Sequence
  Synthetic construct
aaucccaggcccaucaaacug

SEQ ID NO: 4269 - RNA, 21 nt, Artificial Sequence
  Synthetic construct
uccaaaguuacagaagaauuu

SEQ ID NO: 4270 - RNA, 21 nt, Artificial Sequence
  Synthetic construct
agagaauaaacuguuaacaau

SEQ ID NO: 4271 - RNA, 21 nt, Artificial Sequence
  Synthetic construct
uaguucccuuucugcuguuua

SEQ ID NO: 4272 - RNA, 21 nt, Artificial Sequence
  Synthetic construct
augaucucagcucaccacaac

SEQ ID NO: 4273 - RNA, 21 nt, Artificial Sequence
  Synthetic construct
ugagaaauaucauuuauagac

SEQ ID NO: 4274 - RNA, 21 nt, Artificial Sequence
  Synthetic construct
acuuuauggucacuucaacau

SEQ ID NO: 4275 - RNA, 21 nt, Artificial Sequence
  Synthetic construct
auguauccaugugcacuuuua

SEQ ID NO: 4276 - RNA, 21 nt, Artificial Sequence
  Synthetic construct
auugcuuccuuugcagcgaua

SEQ ID NO: 4277 - RNA, 21 nt, Artificial Sequence
  Synthetic construct
aguauuucuguauugagaaug

SEQ ID NO: 4278 - RNA, 21 nt, Artificial Sequence
  Synthetic construct
cauaaagcacaccacacacaa

SEQ ID NO: 4279 - RNA, 21 nt, Artificial Sequence
  Synthetic construct
uggucacuucaacauugcugc

SEQ ID NO: 4280 - RNA, 21 nt, Artificial Sequence
  Synthetic construct
cuuguggguucuucuucuguu

SEQ ID NO: 4281 - RNA, 21 nt, Artificial Sequence
  Synthetic construct
aucucccuagcuuuaacuuau

SEQ ID NO: 4282 - RNA, 21 nt, Artificial Sequence
  Synthetic construct
uugccgaggcuggagugcaau

SEQ ID NO: 4283 - RNA, 21 nt, Artificial Sequence
  Synthetic construct
aguauaacauaguaugcuuca

SEQ ID NO: 4284 - RNA, 21 nt, Artificial Sequence
  Synthetic construct
agggacuacucucuaacuuaa

SEQ ID NO: 4285 - RNA, 21 nt, Artificial Sequence
  Synthetic construct
agaacgaguauagauugauuu

SEQ ID NO: 4286 - RNA, 21 nt, Artificial Sequence
  Synthetic construct
aauauaauuauuuacacgauc

SEQ ID NO: 4287 - RNA, 21 nt, Artificial Sequence
  Synthetic construct
uugguucccaacaaauuaauu

SEQ ID NO: 4288 - RNA, 21 nt, Artificial Sequence
  Synthetic construct
aaggccucucucucucauuag

SEQ ID NO: 4289 - RNA, 21 nt, Artificial Sequence
  Synthetic construct
gauagauguaaggaucaggug

SEQ ID NO: 4290 - RNA, 21 nt, Artificial Sequence
  Synthetic construct
auccaucucaagacagcgauu

SEQ ID NO: 4291 - RNA, 21 nt, Artificial Sequence
  Synthetic construct
aucugaauaacauaaagaaua

SEQ ID NO: 4292 - RNA, 21 nt, Artificial Sequence
  Synthetic construct
uguuuaauauuaaacacauuc

SEQ ID NO: 4293 - RNA, 21 nt, Artificial Sequence
  Synthetic construct
cuucuauaacacaaauuguua

SEQ ID NO: 4294 - RNA, 21 nt, Artificial Sequence
  Synthetic construct
aauaacauaaagaauaaauac

SEQ ID NO: 4295 - RNA, 21 nt, Artificial Sequence
  Synthetic construct
caaugcauuaguagcuacagg

SEQ ID NO: 4296 - RNA, 21 nt, Artificial Sequence
  Synthetic construct
aagccugaaagaaaucugaau

SEQ ID NO: 4297 - RNA, 21 nt, Artificial Sequence
  Synthetic construct
ugaagggucacugcuccaagg

SEQ ID NO: 4298 - RNA, 21 nt, Artificial Sequence
  Synthetic construct
uauagacaaauaucucaaacu

SEQ ID NO: 4299 - RNA, 21 nt, Artificial Sequence
  Synthetic construct
guugagugcugaagaaucccg

SEQ ID NO: 4300 - RNA, 21 nt, Artificial Sequence
  Synthetic construct
accaagagauucaaccgggga

SEQ ID NO: 4301 - RNA, 21 nt, Artificial Sequence
  Synthetic construct
cuuuauaucucuauggaucac

SEQ ID NO: 4302 - RNA, 21 nt, Artificial Sequence
  Synthetic construct
auaaauaccuuuaauccaaag

SEQ ID NO: 4303 - RNA, 21 nt, Artificial Sequence
  Synthetic construct
aaagugguaguaaagaaguac

SEQ ID NO: 4304 - RNA, 21 nt, Artificial Sequence
  Synthetic construct
aaggaauauaauuauuuacac

SEQ ID NO: 4305 - RNA, 21 nt, Artificial Sequence
  Synthetic construct
aggcuuacaaauaaauuacau

SEQ ID NO: 4306 - RNA, 21 nt, Artificial Sequence
  Synthetic construct
ucucaacauguaagggaugcu

SEQ ID NO: 4307 - RNA, 21 nt, Artificial Sequence
  Synthetic construct
gauuaauguaucuauuuccuc

SEQ ID NO: 4308 - RNA, 21 nt, Artificial Sequence
  Synthetic construct
accugaacucaccuagcagga

SEQ ID NO: 4309 - RNA, 21 nt, Artificial Sequence
  Synthetic construct
aguaaaugcuacaaguuguau

SEQ ID NO: 4310 - RNA, 21 nt, Artificial Sequence
  Synthetic construct
aguuguauagaauacucguac

SEQ ID NO: 4311 - RNA, 21 nt, Artificial Sequence
  Synthetic construct
ucauaagcacaagagaggauu

SEQ ID NO: 4312 - RNA, 21 nt, Artificial Sequence
  Synthetic construct
ugcuauguauccaugugcacu

SEQ ID NO: 4313 - RNA, 21 nt, Artificial Sequence
  Synthetic construct
cagaagaauuucacuacacau

SEQ ID NO: 4314 - RNA, 21 nt, Artificial Sequence
  Synthetic construct
auaucucugcccugcaugcuc

SEQ ID NO: 4315 - RNA, 21 nt, Artificial Sequence
  Synthetic construct
accuuuaauccaaaguuacag

SEQ ID NO: 4316 - RNA, 21 nt, Artificial Sequence
  Synthetic construct
auccucaugggauuaugacaa

SEQ ID NO: 4317 - RNA, 21 nt, Artificial Sequence
  Synthetic construct
aauuuguaucauaaguaaaug

SEQ ID NO: 4318 - RNA, 21 nt, Artificial Sequence
  Synthetic construct
agucacuaauguacugauuuu

SEQ ID NO: 4319 - RNA, 21 nt, Artificial Sequence
  Synthetic construct
ucaaauuaauauuaccguuuc

SEQ ID NO: 4320 - RNA, 21 nt, Artificial Sequence
  Synthetic construct
gauuuggauagacucaccugu

SEQ ID NO: 4321 - RNA, 21 nt, Artificial Sequence
  Synthetic construct
uuguugccgaggcuggagugc

SEQ ID NO: 4322 - RNA, 21 nt, Artificial Sequence
  Synthetic construct
cuacacagacacuccgcagau

SEQ ID NO: 4323 - RNA, 21 nt, Artificial Sequence
  Synthetic construct
aaauccaaagcuugcaggcac

SEQ ID NO: 4324 - RNA, 21 nt, Artificial Sequence
  Synthetic construct
auaucucaguucccgcauuug

SEQ ID NO: 4325 - RNA, 21 nt, Artificial Sequence
  Synthetic construct
agucuuuguccauaugcauuu

SEQ ID NO: 4326 - RNA, 21 nt, Artificial Sequence
  Synthetic construct
auuaauuccuucuuggguugc

SEQ ID NO: 4327 - RNA, 21 nt, Artificial Sequence
  Synthetic construct
uguggauauauggaugguuag

SEQ ID NO: 4328 - RNA, 21 nt, Artificial Sequence
  Synthetic construct
uuguuuaaaugugguuucucc

SEQ ID NO: 4329 - RNA, 21 nt, Artificial Sequence
  Synthetic construct
agacacuccgcagauauuuuu

SEQ ID NO: 4330 - RNA, 21 nt, Artificial Sequence
  Synthetic construct
ugugaauccuucagcaucacu

SEQ ID NO: 4331 - RNA, 21 nt, Artificial Sequence
  Synthetic construct
caucuaguccaauacacuuau

SEQ ID NO: 4332 - RNA, 21 nt, Artificial Sequence
  Synthetic construct
cucgauuguaccaaaugugaa

SEQ ID NO: 4333 - RNA, 21 nt, Artificial Sequence
  Synthetic construct
aucuuuguuuacuuaaugucc

SEQ ID NO: 4334 - RNA, 21 nt, Artificial Sequence
  Synthetic construct
uaaucccuguuuauguuauuu

SEQ ID NO: 4335 - RNA, 21 nt, Artificial Sequence
  Synthetic construct
auuacccaacauggugacuga

SEQ ID NO: 4336 - RNA, 21 nt, Artificial Sequence
  Synthetic construct
cauaaucugagggaguaggaa

SEQ ID NO: 4337 - RNA, 21 nt, Artificial Sequence
  Synthetic construct
auaaacccauugagcaaagga

SEQ ID NO: 4338 - RNA, 21 nt, Artificial Sequence
  Synthetic construct
agauguggauauauggauggu

SEQ ID NO: 4339 - RNA, 21 nt, Artificial Sequence
  Synthetic construct
agcuuagauaaagaccaagag

SEQ ID NO: 4340 - RNA, 21 nt, Artificial Sequence
  Synthetic construct
uggagagaauuucaagacauu

SEQ ID NO: 4341 - RNA, 21 nt, Artificial Sequence
  Synthetic construct
acacauucccaaugcauguug

SEQ ID NO: 4342 - RNA, 21 nt, Artificial Sequence
  Synthetic construct
caaguucccauuuauuuccuu

SEQ ID NO: 4343 - RNA, 21 nt, Artificial Sequence
  Synthetic construct
caacacucacaaugcuucuua

SEQ ID NO: 4344 - RNA, 21 nt, Artificial Sequence
  Synthetic construct
augaauacaaauuuauaaaag

SEQ ID NO: 4345 - RNA, 21 nt, Artificial Sequence
  Synthetic construct
ugaauauuaacugcaaguagc

SEQ ID NO: 4346 - RNA, 21 nt, Artificial Sequence
  Synthetic construct
agaggguggugugaccucuuu

SEQ ID NO: 4347 - RNA, 21 nt, Artificial Sequence
  Synthetic construct
ugcagcgauaaucagaggagu

SEQ ID NO: 4348 - RNA, 21 nt, Artificial Sequence
  Synthetic construct
auauucauuuggucacuuaaa

SEQ ID NO: 4349 - RNA, 21 nt, Artificial Sequence
  Synthetic construct
ugcaaguucaacccaauuaag

SEQ ID NO: 4350 - RNA, 21 nt, Artificial Sequence
  Synthetic construct
gaaucaacauugaaagaugug

SEQ ID NO: 4351 - RNA, 21 nt, Artificial Sequence
  Synthetic construct
uaaauagauauauggugaaau

SEQ ID NO: 4352 - RNA, 21 nt, Artificial Sequence
  Synthetic construct
agauguuaugaguauaauccc

SEQ ID NO: 4353 - RNA, 21 nt, Artificial Sequence
  Synthetic construct
guagcuuagauaaagaccaag

SEQ ID NO: 4354 - RNA, 21 nt, Artificial Sequence
  Synthetic construct
agucaggcuggagagaggcuu

SEQ ID NO: 4355 - RNA, 21 nt, Artificial Sequence
  Synthetic construct
aucuuaucaucaauaaugaau

SEQ ID NO: 4356 - RNA, 21 nt, Artificial Sequence
  Synthetic construct
caacauggugacugauuugag

SEQ ID NO: 4357 - RNA, 21 nt, Artificial Sequence
  Synthetic construct
ugggaagugguuuggagcugu

SEQ ID NO: 4358 - RNA, 21 nt, Artificial Sequence
  Synthetic construct
aagaucuuaucaucaauaaug

SEQ ID NO: 4359 - RNA, 21 nt, Artificial Sequence
  Synthetic construct
cauugcucuggaauuccagug

SEQ ID NO: 4360 - RNA, 21 nt, Artificial Sequence
  Synthetic construct
agaaaucugaauaacauaaag

SEQ ID NO: 4361 - RNA, 21 nt, Artificial Sequence
  Synthetic construct
acauuaacguucuuuccuuuu

SEQ ID NO: 4362 - RNA, 21 nt, Artificial Sequence
  Synthetic construct
agggaaagagaauaaacuguu

SEQ ID NO: 4363 - RNA, 21 nt, Artificial Sequence
  Synthetic construct
caggauucuggagcucuggag

SEQ ID NO: 4364 - RNA, 21 nt, Artificial Sequence
  Synthetic construct
caaaugcugaauuucaguccu

SEQ ID NO: 4365 - RNA, 21 nt, Artificial Sequence
  Synthetic construct
caacacuaugaagagggagug

SEQ ID NO: 4366 - RNA, 21 nt, Artificial Sequence
  Synthetic construct
agggcacacuagcaacaucaa

SEQ ID NO: 4367 - RNA, 21 nt, Artificial Sequence
  Synthetic construct
gaagucauuacccaacauggu

SEQ ID NO: 4368 - RNA, 21 nt, Artificial Sequence
  Synthetic construct
caacuuucuguaauuuacaaa

SEQ ID NO: 4369 - RNA, 21 nt, Artificial Sequence
  Synthetic construct
caucucccuagcuuuaacuua

SEQ ID NO: 4370 - RNA, 21 nt, Artificial Sequence
  Synthetic construct
gaaauaggugauacauaggaa

SEQ ID NO: 4371 - RNA, 21 nt, Artificial Sequence
  Synthetic construct
aacaaccuauaaauaggcaga

SEQ ID NO: 4372 - RNA, 21 nt, Artificial Sequence
  Synthetic construct
ugugaccacaucagucagaga

SEQ ID NO: 4373 - RNA, 21 nt, Artificial Sequence
  Synthetic construct
uacaaugcccugaguggauuu

SEQ ID NO: 4374 - RNA, 21 nt, Artificial Sequence
  Synthetic construct
aguccacaugcaaauacacgu

SEQ ID NO: 4375 - RNA, 21 nt, Artificial Sequence
  Synthetic construct
agucuuacucaugagggagau

SEQ ID NO: 4376 - RNA, 21 nt, Artificial Sequence
  Synthetic construct
uagcuuagauaaagaccaaga

SEQ ID NO: 4377 - RNA, 21 nt, Artificial Sequence
  Synthetic construct
auuugcaaggcaaccuauaau

SEQ ID NO: 4378 - RNA, 21 nt, Artificial Sequence
  Synthetic construct
auuugucaacauuucucaaug

SEQ ID NO: 4379 - RNA, 21 nt, Artificial Sequence
  Synthetic construct
guaugcucuggucuuggugcg

SEQ ID NO: 4380 - RNA, 21 nt, Artificial Sequence
  Synthetic construct
cacuauagcaggcugaauuug

SEQ ID NO: 4381 - RNA, 21 nt, Artificial Sequence
  Synthetic construct
cagauucaguuagacauuguu

SEQ ID NO: 4382 - RNA, 21 nt, Artificial Sequence
  Synthetic construct
uauggaugguuagauggaugg

SEQ ID NO: 4383 - RNA, 21 nt, Artificial Sequence
  Synthetic construct
cuuagcuucucuaagaucucc

SEQ ID NO: 4384 - RNA, 21 nt, Artificial Sequence
  Synthetic construct
uccuccugggaagauagagcg

SEQ ID NO: 4385 - RNA, 21 nt, Artificial Sequence
  Synthetic construct
aggucagaaggauggaaccau

SEQ ID NO: 4386 - RNA, 21 nt, Artificial Sequence
  Synthetic construct
caacagauguuaucaaggggg

SEQ ID NO: 4387 - RNA, 21 nt, Artificial Sequence
  Synthetic construct
caacuacugcaaacaaccuau

SEQ ID NO: 4388 - RNA, 21 nt, Artificial Sequence
  Synthetic construct
ucaccuuccaccauuucaauu

SEQ ID NO: 4389 - RNA, 21 nt, Artificial Sequence
  Synthetic construct
aauggaggcucagaugcuguu

SEQ ID NO: 4390 - RNA, 21 nt, Artificial Sequence
  Synthetic construct
cuaguauuuaucccacuacau

SEQ ID NO: 4391 - RNA, 21 nt, Artificial Sequence
  Synthetic construct
cauguucacacaguacuugcu

SEQ ID NO: 4392 - RNA, 21 nt, Artificial Sequence
  Synthetic construct
guacacacaggugugcacaug

SEQ ID NO: 4393 - RNA, 21 nt, Artificial Sequence
  Synthetic construct
acacgagaucagcaagaacga

SEQ ID NO: 4394 - RNA, 21 nt, Artificial Sequence
  Synthetic construct
acuucaacauugcugcccugu

SEQ ID NO: 4395 - RNA, 21 nt, Artificial Sequence
  Synthetic construct
guucccaccauagugcuucgu

SEQ ID NO: 4396 - RNA, 21 nt, Artificial Sequence
  Synthetic construct
aauucugauaaacaaugaaaa

SEQ ID NO: 4397 - RNA, 21 nt, Artificial Sequence
  Synthetic construct
aacaggcagagacaguccuac

SEQ ID NO: 4398 - RNA, 21 nt, Artificial Sequence
  Synthetic construct
cugugcuucucacccuucccu

SEQ ID NO: 4399 - RNA, 21 nt, Artificial Sequence
  Synthetic construct
aauuacauaaucugagggagu

SEQ ID NO: 4400 - RNA, 21 nt, Artificial Sequence
  Synthetic construct
agcgauaaucagaggagucag

SEQ ID NO: 4401 - RNA, 21 nt, Artificial Sequence
  Synthetic construct
ugauugggauguagccuucac

SEQ ID NO: 4402 - RNA, 21 nt, Artificial Sequence
  Synthetic construct
ugggacuugcccuauugguua

SEQ ID NO: 4403 - RNA, 21 nt, Artificial Sequence
  Synthetic construct
uggaucaccugguuugagugc

SEQ ID NO: 4404 - RNA, 21 nt, Artificial Sequence
  Synthetic construct
uuggucaggcuggucucgaac

SEQ ID NO: 4405 - RNA, 21 nt, Artificial Sequence
  Synthetic construct
uccuacauauuuguuuaauga

SEQ ID NO: 4406 - RNA, 21 nt, Artificial Sequence
  Synthetic construct
accacaucagucagagagcca

SEQ ID NO: 4407 - RNA, 21 nt, Artificial Sequence
  Synthetic construct
agagaaacaacuuucuguaau

SEQ ID NO: 4408 - RNA, 21 nt, Artificial Sequence
  Synthetic construct
uccuucuuggguugcuguuga

SEQ ID NO: 4409 - RNA, 21 nt, Artificial Sequence
  Synthetic construct
uacagacaacaggaagcaauu

SEQ ID NO: 4410 - RNA, 21 nt, Artificial Sequence
  Synthetic construct
uggaaucaacauugaaagaug

SEQ ID NO: 4411 - RNA, 21 nt, Artificial Sequence
  Synthetic construct
auaaucugagggaguaggaaa

SEQ ID NO: 4412 - RNA, 21 nt, Artificial Sequence
  Synthetic construct
agugguuuggagcugugguug

SEQ ID NO: 4413 - RNA, 21 nt, Artificial Sequence
  Synthetic construct
ugccuagcgucacauagcaau

SEQ ID NO: 4414 - RNA, 21 nt, Artificial Sequence
  Synthetic construct
aucccgagaagaauauuguca

SEQ ID NO: 4415 - RNA, 21 nt, Artificial Sequence
  Synthetic construct
uauuaaaguucucaccuaaaa

SEQ ID NO: 4416 - RNA, 21 nt, Artificial Sequence
  Synthetic construct
aaagcaauauuauaacaauau

SEQ ID NO: 4417 - RNA, 21 nt, Artificial Sequence
  Synthetic construct
auucccaaugcauguuggguu

SEQ ID NO: 4418 - RNA, 21 nt, Artificial Sequence
  Synthetic construct
cuagcuuuaacuuauagauaa

SEQ ID NO: 4419 - RNA, 21 nt, Artificial Sequence
  Synthetic construct
cauccauacaggucucuguga

SEQ ID NO: 4420 - RNA, 21 nt, Artificial Sequence
  Synthetic construct
uguacucgaaggaugggcugc

SEQ ID NO: 4421 - RNA, 21 nt, Artificial Sequence
  Synthetic construct
uccaaagcuugcaggcacucu

SEQ ID NO: 4422 - RNA, 21 nt, Artificial Sequence
  Synthetic construct
aggugguuaaacucaaacauu

SEQ ID NO: 4423 - RNA, 21 nt, Artificial Sequence
  Synthetic construct
auuuguuuaaugauuucaaag

SEQ ID NO: 4424 - RNA, 21 nt, Artificial Sequence
  Synthetic construct
uugguacaaagugguaguaaa

SEQ ID NO: 4425 - RNA, 21 nt, Artificial Sequence
  Synthetic construct
uaugaagagggagugugcauc

SEQ ID NO: 4426 - RNA, 21 nt, Artificial Sequence
  Synthetic construct
caaauauuuacaaugacacac

SEQ ID NO: 4427 - RNA, 21 nt, Artificial Sequence
  Synthetic construct
cugaaggaagagagaucucug

SEQ ID NO: 4428 - RNA, 21 nt, Artificial Sequence
  Synthetic construct
ugcucuggaauuccagugaau

SEQ ID NO: 4429 - RNA, 21 nt, Artificial Sequence
  Synthetic construct
agagaggccuauguaacugau

SEQ ID NO: 4430 - RNA, 21 nt, Artificial Sequence
  Synthetic construct
gaauacagcugacagucucuc

SEQ ID NO: 4431 - RNA, 21 nt, Artificial Sequence
  Synthetic construct
aaguuucaaacugcaauauuu

SEQ ID NO: 4432 - RNA, 21 nt, Artificial Sequence
  Synthetic construct
cugaccucaggugauccgccu

SEQ ID NO: 4433 - RNA, 21 nt, Artificial Sequence
  Synthetic construct
acugggaacagucaacagaaa

SEQ ID NO: 4434 - RNA, 21 nt, Artificial Sequence
  Synthetic construct
guuaugaguauaaucccagua

SEQ ID NO: 4435 - RNA, 21 nt, Artificial Sequence
  Synthetic construct
uuguuuacuuaauguccaaca

SEQ ID NO: 4436 - RNA, 21 nt, Artificial Sequence
  Synthetic construct
cuauauaguuugcugaaacuc

SEQ ID NO: 4437 - RNA, 21 nt, Artificial Sequence
  Synthetic construct
auucauuuggucacuuaaagg

SEQ ID NO: 4438 - RNA, 21 nt, Artificial Sequence
  Synthetic construct
cuuaaacgugauauuugccau

SEQ ID NO: 4439 - RNA, 21 nt, Artificial Sequence
  Synthetic construct
caccacaaccuccgccuccug

SEQ ID NO: 4440 - RNA, 21 nt, Artificial Sequence
  Synthetic construct
aaugugguuucuccuaugagg

SEQ ID NO: 4441 - RNA, 21 nt, Artificial Sequence
  Synthetic construct
ugagggagauggugaggugua

SEQ ID NO: 4442 - RNA, 21 nt, Artificial Sequence
  Synthetic construct
uggguuauauucauuugguca

SEQ ID NO: 4443 - RNA, 21 nt, Artificial Sequence
  Synthetic construct
aacgcacuggauccuugcuaa

SEQ ID NO: 4444 - RNA, 21 nt, Artificial Sequence
  Synthetic construct
uuacuuugcucaggagugauc

SEQ ID NO: 4445 - RNA, 21 nt, Artificial Sequence
  Synthetic construct
cucugcaacuuguaaguguuu

SEQ ID NO: 4446 - RNA, 21 nt, Artificial Sequence
  Synthetic construct
cucuaagaucuccucaucugu

SEQ ID NO: 4447 - RNA, 21 nt, Artificial Sequence
  Synthetic construct
aggaugucacaguuucaguuu

SEQ ID NO: 4448 - RNA, 21 nt, Artificial Sequence
  Synthetic construct
ucucuacugugcuucucaccc

SEQ ID NO: 4449 - RNA, 21 nt, Artificial Sequence
  Synthetic construct
agaauuucaagacauuuauga

SEQ ID NO: 4450 - RNA, 21 nt, Artificial Sequence
  Synthetic construct
ucacugugggaguugucauca

SEQ ID NO: 4451 - RNA, 21 nt, Artificial Sequence
  Synthetic construct
aauacuuauuagaaauauaca

SEQ ID NO: 4452 - RNA, 21 nt, Artificial Sequence
  Synthetic construct
aguccucuuguucagagcuca

SEQ ID NO: 4453 - RNA, 21 nt, Artificial Sequence
  Synthetic construct
caaacacaacacuaugaagag

SEQ ID NO: 4454 - RNA, 21 nt, Artificial Sequence
  Synthetic construct
cagcuucuaaaggagacuccg

SEQ ID NO: 4455 - RNA, 21 nt, Artificial Sequence
  Synthetic construct
ugggaccauccacuaacuccc

SEQ ID NO: 4456 - RNA, 21 nt, Artificial Sequence
  Synthetic construct
aucaaagauuuggauagacuc

SEQ ID NO: 4457 - RNA, 21 nt, Artificial Sequence
  Synthetic construct
ugggauuacaggcgcccgcca

SEQ ID NO: 4458 - RNA, 21 nt, Artificial Sequence
  Synthetic construct
cuaaccaacagaaagauuaua

SEQ ID NO: 4459 - RNA, 21 nt, Artificial Sequence
  Synthetic construct
aaguagcuaucuaaauaauua

SEQ ID NO: 4460 - RNA, 21 nt, Artificial Sequence
  Synthetic construct
cuuuauggucacuucaacauu

SEQ ID NO: 4461 - RNA, 21 nt, Artificial Sequence
  Synthetic construct
agguauuaaggagauuaacaa

SEQ ID NO: 4462 - RNA, 21 nt, Artificial Sequence
  Synthetic construct
aaauuaagaagccuucuauaa

SEQ ID NO: 4463 - RNA, 21 nt, Artificial Sequence
  Synthetic construct
acagucaugcacaauccauau

SEQ ID NO: 4464 - RNA, 21 nt, Artificial Sequence
  Synthetic construct
ucagggcacacuagcaacauc

SEQ ID NO: 4465 - RNA, 21 nt, Artificial Sequence
  Synthetic construct
agacucaggcuuaaacgugau

SEQ ID NO: 4466 - RNA, 21 nt, Artificial Sequence
  Synthetic construct
ggaccauccacuaacucccag

SEQ ID NO: 4467 - RNA, 21 nt, Artificial Sequence
  Synthetic construct
cugaauaacauaaagaauaaa

SEQ ID NO: 4468 - RNA, 21 nt, Artificial Sequence
  Synthetic construct
uggguugcuguugaagguuca

SEQ ID NO: 4469 - RNA, 21 nt, Artificial Sequence
  Synthetic construct
ugcuacaaguuguauagaaua

SEQ ID NO: 4470 - RNA, 21 nt, Artificial Sequence
  Synthetic construct
cuauaguucccuuucugcugu

SEQ ID NO: 4471 - RNA, 21 nt, Artificial Sequence
  Synthetic construct
gugugcaucuuugagaaaccu

SEQ ID NO: 4472 - RNA, 21 nt, Artificial Sequence
  Synthetic construct
cuagguauagggucugcuuuu

SEQ ID NO: 4473 - RNA, 21 nt, Artificial Sequence
  Synthetic construct
ucuauuuccuccugguaugcc

SEQ ID NO: 4474 - RNA, 21 nt, Artificial Sequence
  Synthetic construct
aauauacauaacucuccaaua

SEQ ID NO: 4475 - RNA, 21 nt, Artificial Sequence
  Synthetic construct
guaaagcucauguauuucugg

SEQ ID NO: 4476 - RNA, 21 nt, Artificial Sequence
  Synthetic construct
uucccuuucugcuguuuauuu

SEQ ID NO: 4477 - RNA, 21 nt, Artificial Sequence
  Synthetic construct
cacaugcaaauacacguucag

SEQ ID NO: 4478 - RNA, 21 nt, Artificial Sequence
  Synthetic construct
ucgagucaccaccucaggugc

SEQ ID NO: 4479 - RNA, 21 nt, Artificial Sequence
  Synthetic construct
gaggugauaucucaguucccg

SEQ ID NO: 4480 - RNA, 21 nt, Artificial Sequence
  Synthetic construct
gucuuggugcgauaacuggug

SEQ ID NO: 4481 - RNA, 21 nt, Artificial Sequence
  Synthetic construct
guuuacuauaucaccuuucuc

SEQ ID NO: 4482 - RNA, 21 nt, Artificial Sequence
  Synthetic construct
cucucugcaacuuguaagugu

SEQ ID NO: 4483 - RNA, 21 nt, Artificial Sequence
  Synthetic construct
acuuucggaccauaagcuuuu

SEQ ID NO: 4484 - RNA, 21 nt, Artificial Sequence
  Synthetic construct
aauauugauugggauguagcc

SEQ ID NO: 4485 - RNA, 21 nt, Artificial Sequence
  Synthetic construct
guuugagugcaggaaauccaa

SEQ ID NO: 4486 - RNA, 21 nt, Artificial Sequence
  Synthetic construct
cagaauuucauuaauaauuaa

SEQ ID NO: 4487 - RNA, 21 nt, Artificial Sequence
  Synthetic construct
aguacuugcucugguauuuuu

SEQ ID NO: 4488 - RNA, 21 nt, Artificial Sequence
  Synthetic construct
uuuccaaguucccauuuauuu

SEQ ID NO: 4489 - RNA, 21 nt, Artificial Sequence
  Synthetic construct
aaacagcuucuuucuaauacu

SEQ ID NO: 4490 - RNA, 21 nt, Artificial Sequence
  Synthetic construct
ugcuaacaacauuaacguucu

SEQ ID NO: 4491 - RNA, 21 nt, Artificial Sequence
  Synthetic construct
agguccaaguuucaaacugca

SEQ ID NO: 4492 - RNA, 21 nt, Artificial Sequence
  Synthetic construct
uucaguccucuuguucagagc

SEQ ID NO: 4493 - RNA, 21 nt, Artificial Sequence
  Synthetic construct
uucucaacauguaagggaugc

SEQ ID NO: 4494 - RNA, 21 nt, Artificial Sequence
  Synthetic construct
gaaggaagagagaucucuggg

SEQ ID NO: 4495 - RNA, 21 nt, Artificial Sequence
  Synthetic construct
uguagauguuaugaguauaau

SEQ ID NO: 4496 - RNA, 21 nt, Artificial Sequence
  Synthetic construct
aggcacucucugcagacagcu

SEQ ID NO: 4497 - RNA, 21 nt, Artificial Sequence
  Synthetic construct
acaucugacucauucucuacu

SEQ ID NO: 4498 - RNA, 21 nt, Artificial Sequence
  Synthetic construct
ccucuuuauuugguacugcug

SEQ ID NO: 4499 - RNA, 21 nt, Artificial Sequence
  Synthetic construct
ucaagccucucccaacuuuua

SEQ ID NO: 4500 - RNA, 21 nt, Artificial Sequence
  Synthetic construct
ucaugagggagauggugaggu

SEQ ID NO: 4501 - RNA, 21 nt, Artificial Sequence
  Synthetic construct
acauugaaagaugugcccucg

SEQ ID NO: 4502 - RNA, 21 nt, Artificial Sequence
  Synthetic construct
ucugcccugcaugcucugcgc

SEQ ID NO: 4503 - RNA, 21 nt, Artificial Sequence
  Synthetic construct
cucugggcgcucuuucuccuu

SEQ ID NO: 4504 - RNA, 21 nt, Artificial Sequence
  Synthetic construct
caccacccuaacacaacugau

SEQ ID NO: 4505 - RNA, 21 nt, Artificial Sequence
  Synthetic construct
acauaaucugagggaguagga

SEQ ID NO: 4506 - RNA, 21 nt, Artificial Sequence
  Synthetic construct
caauaucugcaacagauguua

SEQ ID NO: 4507 - RNA, 21 nt, Artificial Sequence
  Synthetic construct
ucaaugcuaauagcauguaau

SEQ ID NO: 4508 - RNA, 21 nt, Artificial Sequence
  Synthetic construct
caugguuuacagauaacacau

SEQ ID NO: 4509 - RNA, 21 nt, Artificial Sequence
  Synthetic construct
uguaaguguuuagguucacuc

SEQ ID NO: 4510 - RNA, 21 nt, Artificial Sequence
  Synthetic construct
auauuauaacaauaucaaaua

SEQ ID NO: 4511 - RNA, 21 nt, Artificial Sequence
  Synthetic construct
ucuauucauuugaaagguaaa

SEQ ID NO: 4512 - RNA, 21 nt, Artificial Sequence
  Synthetic construct
augggcugcuauguauccaug

SEQ ID NO: 4513 - RNA, 21 nt, Artificial Sequence
  Synthetic construct
gauauauuauuaucaaaucuu

SEQ ID NO: 4514 - RNA, 21 nt, Artificial Sequence
  Synthetic construct
cucaggauucuggagcucugg

SEQ ID NO: 4515 - RNA, 21 nt, Artificial Sequence
  Synthetic construct
auguaagggaugcuaacuaau

SEQ ID NO: 4516 - RNA, 21 nt, Artificial Sequence
  Synthetic construct
aaacugucaguuuacaaaugc

SEQ ID NO: 4517 - RNA, 21 nt, Artificial Sequence
  Synthetic construct
gaauucugucggacugacauu

SEQ ID NO: 4518 - RNA, 21 nt, Artificial Sequence
  Synthetic construct
auagugcuucguuuacuuugc

SEQ ID NO: 4519 - RNA, 21 nt, Artificial Sequence
  Synthetic construct
aucucaguucccgcauuugca

SEQ ID NO: 4520 - RNA, 21 nt, Artificial Sequence
  Synthetic construct
uauugagaaugaccaauaaaa

SEQ ID NO: 4521 - RNA, 21 nt, Artificial Sequence
  Synthetic construct
uggucacuuaaaggagugugg

SEQ ID NO: 4522 - RNA, 21 nt, Artificial Sequence
  Synthetic construct
gagugcugaagaaucccgguu

SEQ ID NO: 4523 - RNA, 21 nt, Artificial Sequence
  Synthetic construct
uaccuuuaauccaaaguuaca

SEQ ID NO: 4524 - RNA, 21 nt, Artificial Sequence
  Synthetic construct
acaucuaaugacaaugcaagu

SEQ ID NO: 4525 - RNA, 21 nt, Artificial Sequence
  Synthetic construct
ccacacacaagcacacacauu

SEQ ID NO: 4526 - RNA, 21 nt, Artificial Sequence
  Synthetic construct
caggugguuaaacucaaacau

SEQ ID NO: 4527 - RNA, 21 nt, Artificial Sequence
  Synthetic construct
uccacauguucacacaguacu

SEQ ID NO: 4528 - RNA, 21 nt, Artificial Sequence
  Synthetic construct
uuauaacaauaucaaauaaaa

SEQ ID NO: 4529 - RNA, 21 nt, Artificial Sequence
  Synthetic construct
ucuugcaaguucaacccaauu

SEQ ID NO: 4530 - RNA, 21 nt, Artificial Sequence
  Synthetic construct
caguaaaugcuacaaguugua

SEQ ID NO: 4531 - RNA, 21 nt, Artificial Sequence
  Synthetic construct
ugcauauguuucauaagcaca

SEQ ID NO: 4532 - RNA, 21 nt, Artificial Sequence
  Synthetic construct
cagcucaccacaaccuccgcc

SEQ ID NO: 4533 - RNA, 21 nt, Artificial Sequence
  Synthetic construct
acuuccacauguucacacagu

SEQ ID NO: 4534 - RNA, 21 nt, Artificial Sequence
  Synthetic construct
guuuacuuaauguccaacaag

SEQ ID NO: 4535 - RNA, 21 nt, Artificial Sequence
  Synthetic construct
uaaauaccuuuaauccaaagu

SEQ ID NO: 4536 - RNA, 21 nt, Artificial Sequence
  Synthetic construct
cuagcaacaucaaagauuugg

SEQ ID NO: 4537 - RNA, 21 nt, Artificial Sequence
  Synthetic construct
acucuagaaagcccagcacua

SEQ ID NO: 4538 - RNA, 21 nt, Artificial Sequence
  Synthetic construct
auaccuuuaauccaaaguuac

SEQ ID NO: 4539 - RNA, 21 nt, Artificial Sequence
  Synthetic construct
agaaagucccaucuuuguuua

SEQ ID NO: 4540 - RNA, 21 nt, Artificial Sequence
  Synthetic construct
caaggcaaccuauaaugccau

SEQ ID NO: 4541 - RNA, 21 nt, Artificial Sequence
  Synthetic construct
ccucauuagaaauaaacccau

SEQ ID NO: 4542 - RNA, 21 nt, Artificial Sequence
  Synthetic construct
aggaaauccaaagcuugcagg

SEQ ID NO: 4543 - RNA, 21 nt, Artificial Sequence
  Synthetic construct
ucuucauuauccagaccguca

SEQ ID NO: 4544 - RNA, 21 nt, Artificial Sequence
  Synthetic construct
acauaaacacguacacuauau

SEQ ID NO: 4545 - RNA, 21 nt, Artificial Sequence
  Synthetic construct
guguuuggaguucuaauagug

SEQ ID NO: 4546 - RNA, 21 nt, Artificial Sequence
  Synthetic construct
acagacacuccgcagauauuu

SEQ ID NO: 4547 - RNA, 21 nt, Artificial Sequence
  Synthetic construct
cuaaauaauuaacaauauuag

SEQ ID NO: 4548 - RNA, 21 nt, Artificial Sequence
  Synthetic construct
cuguugauuuccucuugggua

SEQ ID NO: 4549 - RNA, 21 nt, Artificial Sequence
  Synthetic construct
agcucuggaguuccauuagug

SEQ ID NO: 4550 - RNA, 21 nt, Artificial Sequence
  Synthetic construct
gugauauuauagaaucucuca

SEQ ID NO: 4551 - RNA, 21 nt, Artificial Sequence
  Synthetic construct
accuagcaggaugucacaguu

SEQ ID NO: 4552 - RNA, 21 nt, Artificial Sequence
  Synthetic construct
uuucaccguuugagcuuuauu

SEQ ID NO: 4553 - RNA, 21 nt, Artificial Sequence
  Synthetic construct
ugucacaguuucaguuucagu

SEQ ID NO: 4554 - RNA, 21 nt, Artificial Sequence
  Synthetic construct
ccuugcuaacaacauuaacgu

SEQ ID NO: 4555 - RNA, 21 nt, Artificial Sequence
  Synthetic construct
agcuuuauuuagauauacagu

SEQ ID NO: 4556 - RNA, 21 nt, Artificial Sequence
  Synthetic construct
uauuugcaucccaggauuuca

SEQ ID NO: 4557 - RNA, 21 nt, Artificial Sequence
  Synthetic construct
auugaaauuagugggacuugc

SEQ ID NO: 4558 - RNA, 21 nt, Artificial Sequence
  Synthetic construct
uguaugcucuggucuuggugc

SEQ ID NO: 4559 - RNA, 21 nt, Artificial Sequence
  Synthetic construct
ucacccuucccugacuuuccc

SEQ ID NO: 4560 - RNA, 21 nt, Artificial Sequence
  Synthetic construct
gugauaucucaguucccgcau

SEQ ID NO: 4561 - RNA, 21 nt, Artificial Sequence
  Synthetic construct
caacaggaagcaauuucgugu

SEQ ID NO: 4562 - RNA, 21 nt, Artificial Sequence
  Synthetic construct
cuaccugaaugauauacagua

SEQ ID NO: 4563 - RNA, 21 nt, Artificial Sequence
  Synthetic construct
cucuucaucuucuucuucaga

SEQ ID NO: 4564 - RNA, 21 nt, Artificial Sequence
  Synthetic construct
cacugugggaguugucaucag

SEQ ID NO: 4565 - RNA, 21 nt, Artificial Sequence
  Synthetic construct
aaggauggaaccauaccauca

SEQ ID NO: 4566 - RNA, 21 nt, Artificial Sequence
  Synthetic construct
uguucccagucuuuguccaua

SEQ ID NO: 4567 - RNA, 21 nt, Artificial Sequence
  Synthetic construct
auuacaggcccagauucguuu

SEQ ID NO: 4568 - RNA, 21 nt, Artificial Sequence
  Synthetic construct
guuuggaguaaucgugcccau

SEQ ID NO: 4569 - RNA, 21 nt, Artificial Sequence
  Synthetic construct
ugaaagaugugcccucguuau

SEQ ID NO: 4570 - RNA, 21 nt, Artificial Sequence
  Synthetic construct
aaugugaauccuucagcauca

SEQ ID NO: 4571 - RNA, 21 nt, Artificial Sequence
  Synthetic construct
cucuagguauagggucugcuu

SEQ ID NO: 4572 - RNA, 21 nt, Artificial Sequence
  Synthetic construct
guuucuauucauuugaaaggu

SEQ ID NO: 4573 - RNA, 21 nt, Artificial Sequence
  Synthetic construct
acucaugagggagauggugag

SEQ ID NO: 4574 - RNA, 21 nt, Artificial Sequence
  Synthetic construct
cucagcucaccacaaccuccg

SEQ ID NO: 4575 - RNA, 21 nt, Artificial Sequence
  Synthetic construct
acaccauauuccgaaacagaa

SEQ ID NO: 4576 - RNA, 21 nt, Artificial Sequence
  Synthetic construct
aauuucauuaauaauuaauuc

SEQ ID NO: 4577 - RNA, 21 nt, Artificial Sequence
  Synthetic construct
acaccacacacaagcacacac

SEQ ID NO: 4578 - RNA, 21 nt, Artificial Sequence
  Synthetic construct
agagggagugugcaucuuuga

SEQ ID NO: 4579 - RNA, 21 nt, Artificial Sequence
  Synthetic construct
aaacguuauaaauugucaaaa

SEQ ID NO: 4580 - RNA, 21 nt, Artificial Sequence
  Synthetic construct
agucaugcacaauccauauuu

SEQ ID NO: 4581 - RNA, 21 nt, Artificial Sequence
  Synthetic construct
guauuucugguuguugacugu

SEQ ID NO: 4582 - RNA, 21 nt, Artificial Sequence
  Synthetic construct
uaucucaguucccgcauuugc

SEQ ID NO: 4583 - RNA, 21 nt, Artificial Sequence
  Synthetic construct
agugcugaagaaucccgguug

SEQ ID NO: 4584 - RNA, 21 nt, Artificial Sequence
  Synthetic construct
gaguugucaucagaaaugcua

SEQ ID NO: 4585 - RNA, 21 nt, Artificial Sequence
  Synthetic construct
cacuacuucacaggaaaggag

SEQ ID NO: 4586 - RNA, 21 nt, Artificial Sequence
  Synthetic construct
cucuauguuggucaggcuggu

SEQ ID NO: 4587 - RNA, 21 nt, Artificial Sequence
  Synthetic construct
ucgaaggaugggcugcuaugu

SEQ ID NO: 4588 - RNA, 21 nt, Artificial Sequence
  Synthetic construct
agaauuaaacucuagaaagcc

SEQ ID NO: 4589 - RNA, 21 nt, Artificial Sequence
  Synthetic construct
aucacugugggaguugucauc

SEQ ID NO: 4590 - RNA, 21 nt, Artificial Sequence
  Synthetic construct
cuauaucaccuuucucuagau

SEQ ID NO: 4591 - RNA, 21 nt, Artificial Sequence
  Synthetic construct
aaaugugaauccuucagcauc

SEQ ID NO: 4592 - RNA, 21 nt, Artificial Sequence
  Synthetic construct
acacacaaauauuuacaauga

SEQ ID NO: 4593 - RNA, 21 nt, Artificial Sequence
  Synthetic construct
acucgauuguaccaaauguga

SEQ ID NO: 4594 - RNA, 21 nt, Artificial Sequence
  Synthetic construct
aagaauccuaccugaaugaua

SEQ ID NO: 4595 - RNA, 21 nt, Artificial Sequence
  Synthetic construct
cauaaagaauaaauacuugag

SEQ ID NO: 4596 - RNA, 21 nt, Artificial Sequence
  Synthetic construct
aucagauacaaugcccugagu

SEQ ID NO: 4597 - RNA, 21 nt, Artificial Sequence
  Synthetic construct
acaucacuacccugugaucug

SEQ ID NO: 4598 - RNA, 21 nt, Artificial Sequence
  Synthetic construct
ugcaaacaaccuauaaauagg

SEQ ID NO: 4599 - RNA, 21 nt, Artificial Sequence
  Synthetic construct
cauaguuguaaucccuguuua

SEQ ID NO: 4600 - RNA, 21 nt, Artificial Sequence
  Synthetic construct
acaguccuacauauuuguuua

SEQ ID NO: 4601 - RNA, 21 nt, Artificial Sequence
  Synthetic construct
gggauuaugacaacgcacugg

SEQ ID NO: 4602 - RNA, 21 nt, Artificial Sequence
  Synthetic construct
uccuugcuaacaacauuaacg

SEQ ID NO: 4603 - RNA, 21 nt, Artificial Sequence
  Synthetic construct
acgaagucauuacccaacaug

SEQ ID NO: 4604 - RNA, 21 nt, Artificial Sequence
  Synthetic construct
uacucaugagggagaugguga

SEQ ID NO: 4605 - RNA, 21 nt, Artificial Sequence
  Synthetic construct
agaacuaagcaugaacacacc

SEQ ID NO: 4606 - RNA, 21 nt, Artificial Sequence
  Synthetic construct
aaucaacauugaaagaugugc

SEQ ID NO: 4607 - RNA, 21 nt, Artificial Sequence
  Synthetic construct
ucuuuguuuaaaugugguuuc

SEQ ID NO: 4608 - RNA, 21 nt, Artificial Sequence
  Synthetic construct
cuuugguuagauggucucccu

SEQ ID NO: 4609 - RNA, 21 nt, Artificial Sequence
  Synthetic construct
agaucagcaagaacgaaguca

SEQ ID NO: 4610 - RNA, 21 nt, Artificial Sequence
  Synthetic construct
guuugcugaaacucuaaagaa

SEQ ID NO: 4611 - RNA, 21 nt, Artificial Sequence
  Synthetic construct
agaagccuucuauaacacaaa

SEQ ID NO: 4612 - RNA, 21 nt, Artificial Sequence
  Synthetic construct
cuuugcuuaacugaauauuaa

SEQ ID NO: 4613 - RNA, 21 nt, Artificial Sequence
  Synthetic construct
auaucaacuuucggaccauaa

SEQ ID NO: 4614 - RNA, 21 nt, Artificial Sequence
  Synthetic construct
acacacauauuccucuccacu

SEQ ID NO: 4615 - RNA, 21 nt, Artificial Sequence
  Synthetic construct
auaacauaguaugcuucaaau

SEQ ID NO: 4616 - RNA, 21 nt, Artificial Sequence
  Synthetic construct
caagacacagucaugcacaau

SEQ ID NO: 4617 - RNA, 21 nt, Artificial Sequence
  Synthetic construct
cagauaacacauucugacaaa

SEQ ID NO: 4618 - RNA, 21 nt, Artificial Sequence
  Synthetic construct
guuuaaaugugguuucuccua

SEQ ID NO: 4619 - RNA, 21 nt, Artificial Sequence
  Synthetic construct
aagcagcauaucugaggugac

SEQ ID NO: 4620 - RNA, 21 nt, Artificial Sequence
  Synthetic construct
uggaguaaucgugcccauugc

SEQ ID NO: 4621 - RNA, 21 nt, Artificial Sequence
  Synthetic construct
acgguggaagugaccacuuua

SEQ ID NO: 4622 - RNA, 21 nt, Artificial Sequence
  Synthetic construct
accacaaccuccgccuccugg

SEQ ID NO: 4623 - RNA, 21 nt, Artificial Sequence
  Synthetic construct
agcaauggauucaaccacaga

SEQ ID NO: 4624 - RNA, 21 nt, Artificial Sequence
  Synthetic construct
auuagugggacuugcccuauu

SEQ ID NO: 4625 - RNA, 21 nt, Artificial Sequence
  Synthetic construct
aguuuacccucuuuccagcag

SEQ ID NO: 4626 - RNA, 21 nt, Artificial Sequence
  Synthetic construct
ccucuucaucuucuucuucag

SEQ ID NO: 4627 - RNA, 21 nt, Artificial Sequence
  Synthetic construct
agugggacuugcccuauuggu

SEQ ID NO: 4628 - RNA, 21 nt, Artificial Sequence
  Synthetic construct
guguucccagucuuuguccau

SEQ ID NO: 4629 - RNA, 21 nt, Artificial Sequence
  Synthetic construct
agguucagaaccugaacucac

SEQ ID NO: 4630 - RNA, 21 nt, Artificial Sequence
  Synthetic construct
gaggaggucaagccucuccca

SEQ ID NO: 4631 - RNA, 21 nt, Artificial Sequence
  Synthetic construct
cugguuguugacuguuucuuu

SEQ ID NO: 4632 - RNA, 21 nt, Artificial Sequence
  Synthetic construct
ccuaugaggauuuccuagguu

SEQ ID NO: 4633 - RNA, 21 nt, Artificial Sequence
  Synthetic construct
aagggucacugcuccaagguc

SEQ ID NO: 4634 - RNA, 21 nt, Artificial Sequence
  Synthetic construct
cuauugaaauuagugggacuu

SEQ ID NO: 4635 - RNA, 21 nt, Artificial Sequence
  Synthetic construct
aagagagaucucugggcgcuc

SEQ ID NO: 4636 - RNA, 21 nt, Artificial Sequence
  Synthetic construct
aacccaaagucagucaauuua

SEQ ID NO: 4637 - RNA, 21 nt, Artificial Sequence
  Synthetic construct
cuaaugaauagggcuuccuaa

SEQ ID NO: 4638 - RNA, 21 nt, Artificial Sequence
  Synthetic construct
uggauauauggaugguuagau

SEQ ID NO: 4639 - RNA, 21 nt, Artificial Sequence
  Synthetic construct
uccuaaccagguauugggcuc

SEQ ID NO: 4640 - RNA, 21 nt, Artificial Sequence
  Synthetic construct
ucaugaccagaauuucauuaa

SEQ ID NO: 4641 - RNA, 21 nt, Artificial Sequence
  Synthetic construct
auaaagccuauggaauaauug

SEQ ID NO: 4642 - RNA, 21 nt, Artificial Sequence
  Synthetic construct
caucuccugaacauaaacacg

SEQ ID NO: 4643 - RNA, 21 nt, Artificial Sequence
  Synthetic construct
ugagauacaauucugauaaac

SEQ ID NO: 4644 - RNA, 21 nt, Artificial Sequence
  Synthetic construct
gaucuccucaucugucaucuu

SEQ ID NO: 4645 - RNA, 21 nt, Artificial Sequence
  Synthetic construct
gugacuugccuagcgucacau

SEQ ID NO: 4646 - RNA, 21 nt, Artificial Sequence
  Synthetic construct
uagauguuaugaguauaaucc

SEQ ID NO: 4647 - RNA, 21 nt, Artificial Sequence
  Synthetic construct
gucacuaauguacugauuuuu

SEQ ID NO: 4648 - RNA, 21 nt, Artificial Sequence
  Synthetic construct
uccaaguuucaaacugcaaua

SEQ ID NO: 4649 - RNA, 21 nt, Artificial Sequence
  Synthetic construct
agcuucuuucuaauacuuauu

SEQ ID NO: 4650 - RNA, 21 nt, Artificial Sequence
  Synthetic construct
uccuggguucaagcgauucuc

SEQ ID NO: 4651 - RNA, 21 nt, Artificial Sequence
  Synthetic construct
cggacugacauuucuugggau

SEQ ID NO: 4652 - RNA, 21 nt, Artificial Sequence
  Synthetic construct
ggaagagguacuuagagccaa

SEQ ID NO: 4653 - RNA, 21 nt, Artificial Sequence
  Synthetic construct
cuuaucaucaauaaugaauau

SEQ ID NO: 4654 - RNA, 21 nt, Artificial Sequence
  Synthetic construct
gacuucucuagguauaggguc

SEQ ID NO: 4655 - RNA, 21 nt, Artificial Sequence
  Synthetic construct
aggcuaguauuuaucccacua

SEQ ID NO: 4656 - RNA, 21 nt, Artificial Sequence
  Synthetic construct
agaugugcccucguuaucuca

SEQ ID NO: 4657 - RNA, 21 nt, Artificial Sequence
  Synthetic construct
uguagccuucacugaccuccc

SEQ ID NO: 4658 - RNA, 21 nt, Artificial Sequence
  Synthetic construct
uauucauuugaaagguaaaga

SEQ ID NO: 4659 - RNA, 21 nt, Artificial Sequence
  Synthetic construct
aaugaauuggaaggcugccac

SEQ ID NO: 4660 - RNA, 21 nt, Artificial Sequence
  Synthetic construct
caagccugaaagaaaucugaa

SEQ ID NO: 4661 - RNA, 21 nt, Artificial Sequence
  Synthetic construct
cugugguugagugcugaagaa

SEQ ID NO: 4662 - RNA, 21 nt, Artificial Sequence
  Synthetic construct
aacugaauauuaacugcaagu

SEQ ID NO: 4663 - RNA, 21 nt, Artificial Sequence
  Synthetic construct
guaugcucaaagucugaagga

SEQ ID NO: 4664 - RNA, 21 nt, Artificial Sequence
  Synthetic construct
aaauaucucaaacuaucaaaa

SEQ ID NO: 4665 - RNA, 21 nt, Artificial Sequence
  Synthetic construct
cuuguccuguugcaaugucua

SEQ ID NO: 4666 - RNA, 21 nt, Artificial Sequence
  Synthetic construct
ugaaagcccuuccugaacaca

SEQ ID NO: 4667 - RNA, 21 nt, Artificial Sequence
  Synthetic construct
aauauccuguuggacaagaaa

SEQ ID NO: 4668 - RNA, 21 nt, Artificial Sequence
  Synthetic construct
ugaggauuuccuagguucaga

SEQ ID NO: 4669 - RNA, 21 nt, Artificial Sequence
  Synthetic construct
acagaaauaggugauacauag

SEQ ID NO: 4670 - RNA, 21 nt, Artificial Sequence
  Synthetic construct
agaagcucaaguacaguuaua

SEQ ID NO: 4671 - RNA, 21 nt, Artificial Sequence
  Synthetic construct
ucugcuguaggcagggcauug

SEQ ID NO: 4672 - RNA, 21 nt, Artificial Sequence
  Synthetic construct
cuaacuaaugaauagggcuuc

SEQ ID NO: 4673 - RNA, 21 nt, Artificial Sequence
  Synthetic construct
uacccaacauggugacugauu

SEQ ID NO: 4674 - RNA, 21 nt, Artificial Sequence
  Synthetic construct
agucauuacccaacaugguga

SEQ ID NO: 4675 - RNA, 21 nt, Artificial Sequence
  Synthetic construct
gauuucaguauucuacauuua

SEQ ID NO: 4676 - RNA, 21 nt, Artificial Sequence
  Synthetic construct
cucaacauguaagggaugcua

SEQ ID NO: 4677 - RNA, 21 nt, Artificial Sequence
  Synthetic construct
ggacaucuaaugacaaugcaa

SEQ ID NO: 4678 - RNA, 21 nt, Artificial Sequence
  Synthetic construct
ucuuucauaggagaaauauuc

SEQ ID NO: 4679 - RNA, 21 nt, Artificial Sequence
  Synthetic construct
auguagccuucacugaccucc

SEQ ID NO: 4680 - RNA, 21 nt, Artificial Sequence
  Synthetic construct
cuucauccauacaggucucug

SEQ ID NO: 4681 - RNA, 21 nt, Artificial Sequence
  Synthetic construct
aggcuuauaagaaguuucuau

SEQ ID NO: 4682 - RNA, 21 nt, Artificial Sequence
  Synthetic construct
gcaacagauguuaucaagggg

SEQ ID NO: 4683 - RNA, 21 nt, Artificial Sequence
  Synthetic construct
caguagacaucacuacccugu

SEQ ID NO: 4684 - RNA, 21 nt, Artificial Sequence
  Synthetic construct
cugcuauguauccaugugcac

SEQ ID NO: 4685 - RNA, 21 nt, Artificial Sequence
  Synthetic construct
caagagaggauuaauuuaggu

SEQ ID NO: 4686 - RNA, 21 nt, Artificial Sequence
  Synthetic construct
uguuuacuauaucaccuuucu

SEQ ID NO: 4687 - RNA, 21 nt, Artificial Sequence
  Synthetic construct
auccaaagcuugcaggcacuc

SEQ ID NO: 4688 - RNA, 21 nt, Artificial Sequence
  Synthetic construct
augcauguuggguuauauuca

SEQ ID NO: 4689 - RNA, 21 nt, Artificial Sequence
  Synthetic construct
auggacacacaaauauuuaca

SEQ ID NO: 4690 - RNA, 21 nt, Artificial Sequence
  Synthetic construct
auuucauuaauaauuaauucc

SEQ ID NO: 4691 - RNA, 21 nt, Artificial Sequence
  Synthetic construct
caguccuacauauuuguuuaa

SEQ ID NO: 4692 - RNA, 21 nt, Artificial Sequence
  Synthetic construct
ugguacugcuggugaagcaau

SEQ ID NO: 4693 - RNA, 21 nt, Artificial Sequence
  Synthetic construct
accagauaucaacuuucggac

SEQ ID NO: 4694 - RNA, 21 nt, Artificial Sequence
  Synthetic construct
agaaacagcuucuuucuaaua

SEQ ID NO: 4695 - RNA, 21 nt, Artificial Sequence
  Synthetic construct
gagguuugaaugcaagaggga

SEQ ID NO: 4696 - RNA, 21 nt, Artificial Sequence
  Synthetic construct
accauagugcuucguuuacuu

SEQ ID NO: 4697 - RNA, 21 nt, Artificial Sequence
  Synthetic construct
aacucccaguuuacccucuuu

SEQ ID NO: 4698 - RNA, 21 nt, Artificial Sequence
  Synthetic construct
aagaaucccgguuguuacuau

SEQ ID NO: 4699 - RNA, 21 nt, Artificial Sequence
  Synthetic construct
cacacaaauauuuacaaugac

SEQ ID NO: 4700 - RNA, 21 nt, Artificial Sequence
  Synthetic construct
cuguauaaacaguaccugaug

SEQ ID NO: 4701 - RNA, 21 nt, Artificial Sequence
  Synthetic construct
uucccaguccacaugcaaaua

SEQ ID NO: 4702 - RNA, 21 nt, Artificial Sequence
  Synthetic construct
gcaauaucugcaacagauguu

SEQ ID NO: 4703 - RNA, 21 nt, Artificial Sequence
  Synthetic construct
caaagaacuaagcaugaacac

SEQ ID NO: 4704 - RNA, 21 nt, Artificial Sequence
  Synthetic construct
acacgaucuuugagcugagaa

SEQ ID NO: 4705 - RNA, 21 nt, Artificial Sequence
  Synthetic construct
ucccaacaaauuaauuuguca

SEQ ID NO: 4706 - RNA, 21 nt, Artificial Sequence
  Synthetic construct
ugcccugcaugcucugcgcuc

SEQ ID NO: 4707 - RNA, 21 nt, Artificial Sequence
  Synthetic construct
uucuuggguugcuguugaagg

SEQ ID NO: 4708 - RNA, 21 nt, Artificial Sequence
  Synthetic construct
aggcuuagagaaacaacuuuc

SEQ ID NO: 4709 - RNA, 21 nt, Artificial Sequence
  Synthetic construct
cucaaugcuaauagcauguaa

SEQ ID NO: 4710 - RNA, 21 nt, Artificial Sequence
  Synthetic construct
acauggaggugauaucucagu

SEQ ID NO: 4711 - RNA, 21 nt, Artificial Sequence
  Synthetic construct
caagucauauaaggaauucug

SEQ ID NO: 4712 - RNA, 21 nt, Artificial Sequence
  Synthetic construct
acauaagagacucaggcuuaa

SEQ ID NO: 4713 - RNA, 21 nt, Artificial Sequence
  Synthetic construct
aagugaccacuuuauggucac

SEQ ID NO: 4714 - RNA, 21 nt, Artificial Sequence
  Synthetic construct
agaaggagagaggccuaugua

SEQ ID NO: 4715 - RNA, 21 nt, Artificial Sequence
  Synthetic construct
uccugaacauaaacacguaca

SEQ ID NO: 4716 - RNA, 21 nt, Artificial Sequence
  Synthetic construct
gcugaauguacauaaguucug

SEQ ID NO: 4717 - RNA, 21 nt, Artificial Sequence
  Synthetic construct
acugugggaguugucaucaga

SEQ ID NO: 4718 - RNA, 21 nt, Artificial Sequence
  Synthetic construct
caugggauuaugacaacgcac

SEQ ID NO: 4719 - RNA, 21 nt, Artificial Sequence
  Synthetic construct
cagcugcuaucuguccuucau

SEQ ID NO: 4720 - RNA, 21 nt, Artificial Sequence
  Synthetic construct
agagaauuucaagacauuuau

SEQ ID NO: 4721 - RNA, 21 nt, Artificial Sequence
  Synthetic construct
cugaccucccauuucuuacag

SEQ ID NO: 4722 - RNA, 21 nt, Artificial Sequence
  Synthetic construct
ucaguuuacaaaugcugaauu

SEQ ID NO: 4723 - RNA, 21 nt, Artificial Sequence
  Synthetic construct
agaucuuaucaucaauaauga

SEQ ID NO: 4724 - RNA, 21 nt, Artificial Sequence
  Synthetic construct
acuauaucaccuuucucuaga

SEQ ID NO: 4725 - RNA, 21 nt, Artificial Sequence
  Synthetic construct
cauaacuucuauugaaauuag

SEQ ID NO: 4726 - RNA, 21 nt, Artificial Sequence
  Synthetic construct
gacuuccacauguucacacag

SEQ ID NO: 4727 - RNA, 21 nt, Artificial Sequence
  Synthetic construct
agcagagggcagacaaccugu

SEQ ID NO: 4728 - RNA, 21 nt, Artificial Sequence
  Synthetic construct
acucaaugcauuaguagcuac

SEQ ID NO: 4729 - RNA, 21 nt, Artificial Sequence
  Synthetic construct
cauacaggucucugugaccac

SEQ ID NO: 4730 - RNA, 21 nt, Artificial Sequence
  Synthetic construct
cccaguagacaucacuacccu

SEQ ID NO: 4731 - RNA, 21 nt, Artificial Sequence
  Synthetic construct
ugugggaguugucaucagaaa

SEQ ID NO: 4732 - RNA, 21 nt, Artificial Sequence
  Synthetic construct
aucaaacugucaguuuacaaa

SEQ ID NO: 4733 - RNA, 21 nt, Artificial Sequence
  Synthetic construct
cuaucagauacaaugcccuga

SEQ ID NO: 4734 - RNA, 21 nt, Artificial Sequence
  Synthetic construct
cuuuacauacagacuguaugg

SEQ ID NO: 4735 - RNA, 21 nt, Artificial Sequence
  Synthetic construct
aggcccaucaaacugucaguu

SEQ ID NO: 4736 - RNA, 21 nt, Artificial Sequence
  Synthetic construct
agaauauugucacucuuuaua

SEQ ID NO: 4737 - RNA, 21 nt, Artificial Sequence
  Synthetic construct
gauccuucucaacuuguuuug

SEQ ID NO: 4738 - RNA, 21 nt, Artificial Sequence
  Synthetic construct
caggaaauccaaagcuugcag

SEQ ID NO: 4739 - RNA, 21 nt, Artificial Sequence
  Synthetic construct
cuuuaauccaaaguuacagaa

SEQ ID NO: 4740 - RNA, 21 nt, Artificial Sequence
  Synthetic construct
acucuauuagggcauggacuu

SEQ ID NO: 4741 - RNA, 21 nt, Artificial Sequence
  Synthetic construct
ucucugcccugcaugcucugc

SEQ ID NO: 4742 - RNA, 21 nt, Artificial Sequence
  Synthetic construct
cuaucuuugguucccaacaaa

SEQ ID NO: 4743 - RNA, 21 nt, Artificial Sequence
  Synthetic construct
guuacuauucauccucagugg

SEQ ID NO: 4744 - RNA, 21 nt, Artificial Sequence
  Synthetic construct
uucaaguuacucgauuguacc

SEQ ID NO: 4745 - RNA, 21 nt, Artificial Sequence
  Synthetic construct
ucauuacccaacauggugacu

SEQ ID NO: 4746 - RNA, 21 nt, Artificial Sequence
  Synthetic construct
acaauauuaggguucuuauuu

SEQ ID NO: 4747 - RNA, 21 nt, Artificial Sequence
  Synthetic construct
caaauuaauuugucaacauuu

SEQ ID NO: 4748 - RNA, 21 nt, Artificial Sequence
  Synthetic construct
uuccaccacccuaacacaacu

SEQ ID NO: 4749 - RNA, 21 nt, Artificial Sequence
  Synthetic construct
guucagagcucagagacuggg

SEQ ID NO: 4750 - RNA, 21 nt, Artificial Sequence
  Synthetic construct
acuucucuagguauagggucu

SEQ ID NO: 4751 - RNA, 21 nt, Artificial Sequence
  Synthetic construct
cauauguuucauaagcacaag

SEQ ID NO: 4752 - RNA, 21 nt, Artificial Sequence
  Synthetic construct
aacuguaaaugaauuggaagg

SEQ ID NO: 4753 - RNA, 21 nt, Artificial Sequence
  Synthetic construct
caaagugcugggauuacaggu

SEQ ID NO: 4754 - RNA, 21 nt, Artificial Sequence
  Synthetic construct
accaaguagcuaucuaaauaa

SEQ ID NO: 4755 - RNA, 21 nt, Artificial Sequence
  Synthetic construct
guuagaaggaaguuauccuuu

SEQ ID NO: 4756 - RNA, 21 nt, Artificial Sequence
  Synthetic construct
cagaagauucaggaagugcca

SEQ ID NO: 4757 - RNA, 21 nt, Artificial Sequence
  Synthetic construct
cacacauauuccucuccacuu

SEQ ID NO: 4758 - RNA, 21 nt, Artificial Sequence
  Synthetic construct
gaaacaacuguaaaugaauug

SEQ ID NO: 4759 - RNA, 21 nt, Artificial Sequence
  Synthetic construct
gauauuauagaaucucucaga

SEQ ID NO: 4760 - RNA, 21 nt, Artificial Sequence
  Synthetic construct
gucuagugcuguauaaacagu

SEQ ID NO: 4761 - RNA, 21 nt, Artificial Sequence
  Synthetic construct
augcugaggucagaaggaugg

SEQ ID NO: 4762 - RNA, 21 nt, Artificial Sequence
  Synthetic construct
accuuugcuuaacugaauauu

SEQ ID NO: 4763 - RNA, 21 nt, Artificial Sequence
  Synthetic construct
aagcaauauuauaacaauauc

SEQ ID NO: 4764 - RNA, 21 nt, Artificial Sequence
  Synthetic construct
aggaucaggugguuaaacuca

SEQ ID NO: 4765 - RNA, 21 nt, Artificial Sequence
  Synthetic construct
cuauggaucaccugguuugag

SEQ ID NO: 4766 - RNA, 21 nt, Artificial Sequence
  Synthetic construct
uucccacugcccuauuccuaa

SEQ ID NO: 4767 - RNA, 21 nt, Artificial Sequence
  Synthetic construct
uacacaugguuuacagauaac

SEQ ID NO: 4768 - RNA, 21 nt, Artificial Sequence
  Synthetic construct
acugcccuauuccuaacucag

SEQ ID NO: 4769 - RNA, 21 nt, Artificial Sequence
  Synthetic construct
ugcacaauccauauuucaauu

SEQ ID NO: 4770 - RNA, 21 nt, Artificial Sequence
  Synthetic construct
caggaugucacaguuucaguu

SEQ ID NO: 4771 - RNA, 21 nt, Artificial Sequence
  Synthetic construct
aacucaccuagcaggauguca

SEQ ID NO: 4772 - RNA, 21 nt, Artificial Sequence
  Synthetic construct
gauccuugcuaacaacauuaa

SEQ ID NO: 4773 - RNA, 21 nt, Artificial Sequence
  Synthetic construct
cacaccacacacaagcacaca

SEQ ID NO: 4774 - RNA, 21 nt, Artificial Sequence
  Synthetic construct
aggagaagcucaaguacaguu

SEQ ID NO: 4775 - RNA, 21 nt, Artificial Sequence
  Synthetic construct
ccuguugcaaugucuagugcu

SEQ ID NO: 4776 - RNA, 21 nt, Artificial Sequence
  Synthetic construct
guugcaaugucuagugcugua

SEQ ID NO: 4777 - RNA, 21 nt, Artificial Sequence
  Synthetic construct
acuugaguuaaaucuucuuac

SEQ ID NO: 4778 - RNA, 21 nt, Artificial Sequence
  Synthetic construct
gcuaauagcauguaauuacuu

SEQ ID NO: 4779 - RNA, 21 nt, Artificial Sequence
  Synthetic construct
uccuccugguaugccuauuuu

SEQ ID NO: 4780 - RNA, 21 nt, Artificial Sequence
  Synthetic construct
cuggauccuugcuaacaacau

SEQ ID NO: 4781 - RNA, 21 nt, Artificial Sequence
  Synthetic construct
ucccugacuuucccacugccc

SEQ ID NO: 4782 - RNA, 21 nt, Artificial Sequence
  Synthetic construct
caaauaucucaaacuaucaaa

SEQ ID NO: 4783 - RNA, 21 nt, Artificial Sequence
  Synthetic construct
gugaccacaucagucagagag

SEQ ID NO: 4784 - RNA, 21 nt, Artificial Sequence
  Synthetic construct
aauaggugauacauaggaaaa

SEQ ID NO: 4785 - RNA, 21 nt, Artificial Sequence
  Synthetic construct
ugcaaauacacguucagaauu

SEQ ID NO: 4786 - RNA, 21 nt, Artificial Sequence
  Synthetic construct
guauugggcucucuccacugg

SEQ ID NO: 4787 - RNA, 21 nt, Artificial Sequence
  Synthetic construct
augucuagugcuguauaaaca

SEQ ID NO: 4788 - RNA, 21 nt, Artificial Sequence
  Synthetic construct
gucucgaacuccugaccucag

SEQ ID NO: 4789 - RNA, 21 nt, Artificial Sequence
  Synthetic construct
aaacaacuuucuguaauuuac

SEQ ID NO: 4790 - RNA, 21 nt, Artificial Sequence
  Synthetic construct
uggugaaauaguagucaaauu

SEQ ID NO: 4791 - RNA, 21 nt, Artificial Sequence
  Synthetic construct
acuuuacauacagacuguaug

SEQ ID NO: 4792 - RNA, 21 nt, Artificial Sequence
  Synthetic construct
ucccgagaagaauauugucac

SEQ ID NO: 4793 - RNA, 21 nt, Artificial Sequence
  Synthetic construct
acaaccugguuuacucaauua

SEQ ID NO: 4794 - RNA, 21 nt, Artificial Sequence
  Synthetic construct
uguugauuuccucuuggguac

SEQ ID NO: 4795 - RNA, 21 nt, Artificial Sequence
  Synthetic construct
auaauuccaccacccuaacac

SEQ ID NO: 4796 - RNA, 21 nt, Artificial Sequence
  Synthetic construct
ccacauguucacacaguacuu

SEQ ID NO: 4797 - RNA, 21 nt, Artificial Sequence
  Synthetic construct
uggagagguuaagugacuugc

SEQ ID NO: 4798 - RNA, 21 nt, Artificial Sequence
  Synthetic construct
gaaagaaaucugaauaacaua

SEQ ID NO: 4799 - RNA, 21 nt, Artificial Sequence
  Synthetic construct
aucauaaguaaaugaugauua

SEQ ID NO: 4800 - RNA, 21 nt, Artificial Sequence
  Synthetic construct
gagcuuuauuuagauauacag

SEQ ID NO: 4801 - RNA, 21 nt, Artificial Sequence
  Synthetic construct
aguugucaucagaaaugcuau

SEQ ID NO: 4802 - RNA, 21 nt, Artificial Sequence
  Synthetic construct
ccgguuguuacuauucauccu

SEQ ID NO: 4803 - RNA, 21 nt, Artificial Sequence
  Synthetic construct
gacaguccuacauauuuguuu

SEQ ID NO: 4804 - RNA, 21 nt, Artificial Sequence
  Synthetic construct
cuccugggaagauagagcgaa

SEQ ID NO: 4805 - RNA, 21 nt, Artificial Sequence
  Synthetic construct
augugcccucguuaucucagg

SEQ ID NO: 4806 - RNA, 21 nt, Artificial Sequence
  Synthetic construct
agugacuucucuagguauagg

SEQ ID NO: 4807 - RNA, 21 nt, Artificial Sequence
  Synthetic construct
ugcuguuuauuuauuguaaag

SEQ ID NO: 4808 - RNA, 21 nt, Artificial Sequence
  Synthetic construct
guggguucuucuucuguucca

SEQ ID NO: 4809 - RNA, 21 nt, Artificial Sequence
  Synthetic construct
cuugccuagcgucacauagca

SEQ ID NO: 4810 - RNA, 21 nt, Artificial Sequence
  Synthetic construct
acccaggcaagcauaaagccu

SEQ ID NO: 4811 - RNA, 21 nt, Artificial Sequence
  Synthetic construct
acauauuuguuuaaugauuuc

SEQ ID NO: 4812 - RNA, 21 nt, Artificial Sequence
  Synthetic construct
guuaaacucaaacauuggggu

SEQ ID NO: 4813 - RNA, 21 nt, Artificial Sequence
  Synthetic construct
gcaucuuugagaaaccuuuuu

SEQ ID NO: 4814 - RNA, 21 nt, Artificial Sequence
  Synthetic construct
uguaagggaugcuaacuaaug

SEQ ID NO: 4815 - RNA, 21 nt, Artificial Sequence
  Synthetic construct
uuccaaguucccauuuauuuc

SEQ ID NO: 4816 - RNA, 21 nt, Artificial Sequence
  Synthetic construct
gugcaucuuugagaaaccuuu

SEQ ID NO: 4817 - RNA, 21 nt, Artificial Sequence
  Synthetic construct
caagaacgaagucauuaccca

SEQ ID NO: 4818 - RNA, 21 nt, Artificial Sequence
  Synthetic construct
aggucaagccucucccaacuu

SEQ ID NO: 4819 - RNA, 21 nt, Artificial Sequence
  Synthetic construct
guucagaaccugaacucaccu

SEQ ID NO: 4820 - RNA, 21 nt, Artificial Sequence
  Synthetic construct
cacgguggaagugaccacuuu

SEQ ID NO: 4821 - RNA, 21 nt, Artificial Sequence
  Synthetic construct
aucuugcaaguucaacccaau

SEQ ID NO: 4822 - RNA, 21 nt, Artificial Sequence
  Synthetic construct
ugggcucugcuaucuugugcc

SEQ ID NO: 4823 - RNA, 21 nt, Artificial Sequence
  Synthetic construct
cuagguucagaaccugaacuc

SEQ ID NO: 4824 - RNA, 21 nt, Artificial Sequence
  Synthetic construct
cuagcgucacauagcaauuua

SEQ ID NO: 4825 - RNA, 21 nt, Artificial Sequence
  Synthetic construct
cacauauuccucuccacuuuu

SEQ ID NO: 4826 - RNA, 21 nt, Artificial Sequence
  Synthetic construct
cugaaugauauacaguaauau

SEQ ID NO: 4827 - RNA, 21 nt, Artificial Sequence
  Synthetic construct
augaccagaauuucauuaaua

SEQ ID NO: 4828 - RNA, 21 nt, Artificial Sequence
  Synthetic construct
cacagaacgaguauagauuga

SEQ ID NO: 4829 - RNA, 21 nt, Artificial Sequence
  Synthetic construct
aaacccauugagcaaaggaau

SEQ ID NO: 4830 - RNA, 21 nt, Artificial Sequence
  Synthetic construct
ugguacaaagugguaguaaag

SEQ ID NO: 4831 - RNA, 21 nt, Artificial Sequence
  Synthetic construct
aacucuaaagaaagugcuuuc

SEQ ID NO: 4832 - RNA, 21 nt, Artificial Sequence
  Synthetic construct
aacagaaagauuauaucaaaa

SEQ ID NO: 4833 - RNA, 21 nt, Artificial Sequence
  Synthetic construct
cugaacugaaagcauaagaga

SEQ ID NO: 4834 - RNA, 21 nt, Artificial Sequence
  Synthetic construct
aagaugugcccucguuaucuc

SEQ ID NO: 4835 - RNA, 21 nt, Artificial Sequence
  Synthetic construct
ucccuagcuuuaacuuauaga

SEQ ID NO: 4836 - RNA, 21 nt, Artificial Sequence
  Synthetic construct
cauuucucaaugcuaauagca

SEQ ID NO: 4837 - RNA, 21 nt, Artificial Sequence
  Synthetic construct
caaauuaauauuaccguuuca

SEQ ID NO: 4838 - RNA, 21 nt, Artificial Sequence
  Synthetic construct
agcccuuccugaacacacaua

SEQ ID NO: 4839 - RNA, 21 nt, Artificial Sequence
  Synthetic construct
uauggaucaccugguuugagu

SEQ ID NO: 4840 - RNA, 21 nt, Artificial Sequence
  Synthetic construct
uguggguucuucuucuguucc

SEQ ID NO: 4841 - RNA, 21 nt, Artificial Sequence
  Synthetic construct
agcuugcaggcacucucugca

SEQ ID NO: 4842 - RNA, 21 nt, Artificial Sequence
  Synthetic construct
aauaucauuuauagacaaaua

SEQ ID NO: 4843 - RNA, 21 nt, Artificial Sequence
  Synthetic construct
cuccugaacauaaacacguac

SEQ ID NO: 4844 - RNA, 21 nt, Artificial Sequence
  Synthetic construct
aauggauucaaccacagaacg

SEQ ID NO: 4845 - RNA, 21 nt, Artificial Sequence
  Synthetic construct
aauuucccggcacuaugagug

SEQ ID NO: 4846 - RNA, 21 nt, Artificial Sequence
  Synthetic construct
aguauuuaucccacuacaucu

SEQ ID NO: 4847 - RNA, 21 nt, Artificial Sequence
  Synthetic construct
auuucaccguuugagcuuuau

SEQ ID NO: 4848 - RNA, 21 nt, Artificial Sequence
  Synthetic construct
auuuaguaauaaagcucauau

SEQ ID NO: 4849 - RNA, 21 nt, Artificial Sequence
  Synthetic construct
acuuguaaguguuuagguuca

SEQ ID NO: 4850 - RNA, 21 nt, Artificial Sequence
  Synthetic construct
cucuccaauacagggaagggg

SEQ ID NO: 4851 - RNA, 21 nt, Artificial Sequence
  Synthetic construct
cuuucuaauacuuauuagaaa

SEQ ID NO: 4852 - RNA, 21 nt, Artificial Sequence
  Synthetic construct
ugcccucguuaucucagggca

SEQ ID NO: 4853 - RNA, 21 nt, Artificial Sequence
  Synthetic construct
acucuaaagaaagugcuuuca

SEQ ID NO: 4854 - RNA, 21 nt, Artificial Sequence
  Synthetic construct
auauuccgaaacagaaauagg

SEQ ID NO: 4855 - RNA, 21 nt, Artificial Sequence
  Synthetic construct
ucacaagccugaaagaaaucu

SEQ ID NO: 4856 - RNA, 21 nt, Artificial Sequence
  Synthetic construct
aggaucaucuaguccaauaca

SEQ ID NO: 4857 - RNA, 21 nt, Artificial Sequence
  Synthetic construct
accucuuuauuugguacugcu

SEQ ID NO: 4858 - RNA, 21 nt, Artificial Sequence
  Synthetic construct
aucccuguuuauguuauuuaa

SEQ ID NO: 4859 - RNA, 21 nt, Artificial Sequence
  Synthetic construct
aguuucaaacugcaauauuuu

SEQ ID NO: 4860 - RNA, 21 nt, Artificial Sequence
  Synthetic construct
agauuggaugcugaggucaga

SEQ ID NO: 4861 - RNA, 21 nt, Artificial Sequence
  Synthetic construct
acacucaagacacagucaugc

SEQ ID NO: 4862 - RNA, 21 nt, Artificial Sequence
  Synthetic construct
guggauccuucucaacuuguu

SEQ ID NO: 4863 - RNA, 21 nt, Artificial Sequence
  Synthetic construct
augacuacccauaguucauca

SEQ ID NO: 4864 - RNA, 21 nt, Artificial Sequence
  Synthetic construct
auaucaccuuucucuagaucu

SEQ ID NO: 4865 - RNA, 21 nt, Artificial Sequence
  Synthetic construct
guuauauucuagcaaguguga

SEQ ID NO: 4866 - RNA, 21 nt, Artificial Sequence
  Synthetic construct
aaagcagagggcagacaaccu

SEQ ID NO: 4867 - RNA, 21 nt, Artificial Sequence
  Synthetic construct
acaaggauuucaguauucuac

SEQ ID NO: 4868 - RNA, 21 nt, Artificial Sequence
  Synthetic construct
gaauguacauaaguucuguuu

SEQ ID NO: 4869 - RNA, 21 nt, Artificial Sequence
  Synthetic construct
acagaacuauaacugaaugcc

SEQ ID NO: 4870 - RNA, 21 nt, Artificial Sequence
  Synthetic construct
aauccuaccugaaugauauac

SEQ ID NO: 4871 - RNA, 21 nt, Artificial Sequence
  Synthetic construct
ugaguuagaaggaaguuaucc

SEQ ID NO: 4872 - RNA, 21 nt, Artificial Sequence
  Synthetic construct
acuuaauguccaacaaggauu

SEQ ID NO: 4873 - RNA, 21 nt, Artificial Sequence
  Synthetic construct
aauuugcaaggcaaccuauaa

SEQ ID NO: 4874 - RNA, 21 nt, Artificial Sequence
  Synthetic construct
ucucugcagacagcugcuauc

SEQ ID NO: 4875 - RNA, 21 nt, Artificial Sequence
  Synthetic construct
acuugagaauuaaacucuaga

SEQ ID NO: 4876 - RNA, 21 nt, Artificial Sequence
  Synthetic construct
acugcaaguagcuuagauaaa

SEQ ID NO: 4877 - RNA, 21 nt, Artificial Sequence
  Synthetic construct
cucucucucauuagagcagug

SEQ ID NO: 4878 - RNA, 21 nt, Artificial Sequence
  Synthetic construct
cacaugaaucguaugcucaaa

SEQ ID NO: 4879 - RNA, 21 nt, Artificial Sequence
  Synthetic construct
aucuugguacaaagugguagu

SEQ ID NO: 4880 - RNA, 21 nt, Artificial Sequence
  Synthetic construct
gagacugggagauacuugcac

SEQ ID NO: 4881 - RNA, 21 nt, Artificial Sequence
  Synthetic construct
uguaaggaucaggugguuaaa

SEQ ID NO: 4882 - RNA, 21 nt, Artificial Sequence
  Synthetic construct
cuuauucuucucuucaggggc

SEQ ID NO: 4883 - RNA, 21 nt, Artificial Sequence
  Synthetic construct
ucuuacucaugagggagaugg

SEQ ID NO: 4884 - RNA, 21 nt, Artificial Sequence
  Synthetic construct
aaguuacucgauuguaccaaa

SEQ ID NO: 4885 - RNA, 21 nt, Artificial Sequence
  Synthetic construct
cggaauacagcugacagucuc

SEQ ID NO: 4886 - RNA, 21 nt, Artificial Sequence
  Synthetic construct
ugugaccucuuuauuugguac

SEQ ID NO: 4887 - RNA, 21 nt, Artificial Sequence
  Synthetic construct
guauagaauacucguacacac

SEQ ID NO: 4888 - RNA, 21 nt, Artificial Sequence
  Synthetic construct
cauuguuuaauauuaaacaca

SEQ ID NO: 4889 - RNA, 21 nt, Artificial Sequence
  Synthetic construct
uaagcacaagagaggauuaau

SEQ ID NO: 4890 - RNA, 21 nt, Artificial Sequence
  Synthetic construct
cacauccaucucaagacagcg

SEQ ID NO: 4891 - RNA, 21 nt, Artificial Sequence
  Synthetic construct
gauguagccuucacugaccuc

SEQ ID NO: 4892 - RNA, 21 nt, Artificial Sequence
  Synthetic construct
cuuuguccauaugcauuucuu

SEQ ID NO: 4893 - RNA, 21 nt, Artificial Sequence
  Synthetic construct
cagggaaagagaauaaacugu

SEQ ID NO: 4894 - RNA, 21 nt, Artificial Sequence
  Synthetic construct
uaaugacaaugcaagugaaaa

SEQ ID NO: 4895 - RNA, 21 nt, Artificial Sequence
  Synthetic construct
acuucauuugcuugaguuuuu

SEQ ID NO: 4896 - RNA, 21 nt, Artificial Sequence
  Synthetic construct
cucagagaaagucccaucuuu

SEQ ID NO: 4897 - RNA, 21 nt, Artificial Sequence
  Synthetic construct
aucuauuuccuccugguaugc

SEQ ID NO: 4898 - RNA, 21 nt, Artificial Sequence
  Synthetic construct
agguaucauuaucuuuguuua

SEQ ID NO: 4899 - RNA, 21 nt, Artificial Sequence
  Synthetic construct
caaagauuuggauagacucac

SEQ ID NO: 4900 - RNA, 21 nt, Artificial Sequence
  Synthetic construct
ugcuucucacccuucccugac

SEQ ID NO: 4901 - RNA, 21 nt, Artificial Sequence
  Synthetic construct
ucuggaauuccagugaauucc

SEQ ID NO: 4902 - RNA, 21 nt, Artificial Sequence
  Synthetic construct
ugcugaacugaaagcauaaga

SEQ ID NO: 4903 - RNA, 21 nt, Artificial Sequence
  Synthetic construct
guaucauaaguaaaugaugau

SEQ ID NO: 4904 - RNA, 21 nt, Artificial Sequence
  Synthetic construct
guuauauucauuuggucacuu

SEQ ID NO: 4905 - RNA, 21 nt, Artificial Sequence
  Synthetic construct
caaagucagucaauuuaacag

SEQ ID NO: 4906 - RNA, 21 nt, Artificial Sequence
  Synthetic construct
caccuuucucuagaucuuuaa

SEQ ID NO: 4907 - RNA, 21 nt, Artificial Sequence
  Synthetic construct
gugcaggaaauccaaagcuug

SEQ ID NO: 4908 - RNA, 21 nt, Artificial Sequence
  Synthetic construct
gucaacauuucucaaugcuaa

SEQ ID NO: 4909 - RNA, 21 nt, Artificial Sequence
  Synthetic construct
cacacacaagcacacacauug

SEQ ID NO: 4910 - RNA, 21 nt, Artificial Sequence
  Synthetic construct
gcuaucagauacaaugcccug

SEQ ID NO: 4911 - RNA, 21 nt, Artificial Sequence
  Synthetic construct
uguaaucccuguuuauguuau

SEQ ID NO: 4912 - RNA, 21 nt, Artificial Sequence
  Synthetic construct
cuaaguauuucuguauugaga

SEQ ID NO: 4913 - RNA, 21 nt, Artificial Sequence
  Synthetic construct
acaguacuugcucugguauuu

SEQ ID NO: 4914 - RNA, 21 nt, Artificial Sequence
  Synthetic construct
accauccacuaacucccaguu

SEQ ID NO: 4915 - RNA, 21 nt, Artificial Sequence
  Synthetic construct
cagaaggauggaaccauacca

SEQ ID NO: 4916 - RNA, 21 nt, Artificial Sequence
  Synthetic construct
ugguauuugcggguccauaaa

SEQ ID NO: 4917 - RNA, 21 nt, Artificial Sequence
  Synthetic construct
ugaaugauauacaguaauauc

SEQ ID NO: 4918 - RNA, 21 nt, Artificial Sequence
  Synthetic construct
ugcuucaaccacaauuuaaaa

SEQ ID NO: 4919 - RNA, 21 nt, Artificial Sequence
  Synthetic construct
caugaucucagcucaccacaa

SEQ ID NO: 4920 - RNA, 21 nt, Artificial Sequence
  Synthetic construct
caguccucuuguucagagcuc

SEQ ID NO: 4921 - RNA, 21 nt, Artificial Sequence
  Synthetic construct
aaucccgguuguuacuauuca

SEQ ID NO: 4922 - RNA, 21 nt, Artificial Sequence
  Synthetic construct
auauaauuauuuacacgaucu

SEQ ID NO: 4923 - RNA, 21 nt, Artificial Sequence
  Synthetic construct
gcuguucuuaauugcuuccuu

SEQ ID NO: 4924 - RNA, 21 nt, Artificial Sequence
  Synthetic construct
uugcugcccuguuugggcugc

SEQ ID NO: 4925 - RNA, 21 nt, Artificial Sequence
  Synthetic construct
ucagguauuaaggagauuaac

SEQ ID NO: 4926 - RNA, 21 nt, Artificial Sequence
  Synthetic construct
ucucagggcacacuagcaaca

SEQ ID NO: 4927 - RNA, 21 nt, Artificial Sequence
  Synthetic construct
acuguuucuuuggaaucauag

SEQ ID NO: 4928 - RNA, 21 nt, Artificial Sequence
  Synthetic construct
cucagggcacacuagcaacau

SEQ ID NO: 4929 - RNA, 21 nt, Artificial Sequence
  Synthetic construct
cuguaaaugaauuggaaggcu

SEQ ID NO: 4930 - RNA, 21 nt, Artificial Sequence
  Synthetic construct
aaguuacagaagaauuucacu

SEQ ID NO: 4931 - RNA, 21 nt, Artificial Sequence
  Synthetic construct
agagaggauuaauuuagguau

SEQ ID NO: 4932 - RNA, 21 nt, Artificial Sequence
  Synthetic construct
ucuauuagggcauggacuucc

SEQ ID NO: 4933 - RNA, 21 nt, Artificial Sequence
  Synthetic construct
ugguucccaacaaauuaauuu

SEQ ID NO: 4934 - RNA, 21 nt, Artificial Sequence
  Synthetic construct
gacauuuaugaauaugcuuuu

SEQ ID NO: 4935 - RNA, 21 nt, Artificial Sequence
  Synthetic construct
accaacagaaagauuauauca

SEQ ID NO: 4936 - RNA, 21 nt, Artificial Sequence
  Synthetic construct
guuccuguacaaaguacugga

SEQ ID NO: 4937 - RNA, 21 nt, Artificial Sequence
  Synthetic construct
acauguucacacaguacuugc

SEQ ID NO: 4938 - RNA, 21 nt, Artificial Sequence
  Synthetic construct
ugcuaauagcauguaauuacu

SEQ ID NO: 4939 - RNA, 21 nt, Artificial Sequence
  Synthetic construct
auagauauauggugaaauagu

SEQ ID NO: 4940 - RNA, 21 nt, Artificial Sequence
  Synthetic construct
guacaguuauauucuagcaag

SEQ ID NO: 4941 - RNA, 21 nt, Artificial Sequence
  Synthetic construct
uagcggcugcuguucuuaauu

SEQ ID NO: 4942 - RNA, 21 nt, Artificial Sequence
  Synthetic construct
caccguuugagcuuuauuuag

SEQ ID NO: 4943 - RNA, 21 nt, Artificial Sequence
  Synthetic construct
accauaccaucagcaggucua

SEQ ID NO: 4944 - RNA, 21 nt, Artificial Sequence
  Synthetic construct
caagacauuuaugaauaugcu

SEQ ID NO: 4945 - RNA, 21 nt, Artificial Sequence
  Synthetic construct
gacugggagauacuugcacua

SEQ ID NO: 4946 - RNA, 21 nt, Artificial Sequence
  Synthetic construct
cuuguaaguguuuagguucac

SEQ ID NO: 4947 - RNA, 21 nt, Artificial Sequence
  Synthetic construct
aguaaucgugcccauugcucu

SEQ ID NO: 4948 - RNA, 21 nt, Artificial Sequence
  Synthetic construct
uaagagacucaggcuuaaacg

SEQ ID NO: 4949 - RNA, 21 nt, Artificial Sequence
  Synthetic construct
acaugcaaauacacguucaga

SEQ ID NO: 4950 - RNA, 21 nt, Artificial Sequence
  Synthetic construct
aauccaaaguuacagaagaau

SEQ ID NO: 4951 - RNA, 21 nt, Artificial Sequence
  Synthetic construct
ucuuucgcuucacgguggaag

SEQ ID NO: 4952 - RNA, 21 nt, Artificial Sequence
  Synthetic construct
augcucaaagucugaaggaag

SEQ ID NO: 4953 - RNA, 21 nt, Artificial Sequence
  Synthetic construct
auggaacauggacacacaaau

SEQ ID NO: 4954 - RNA, 21 nt, Artificial Sequence
  Synthetic construct
aucaacuuucggaccauaagc

SEQ ID NO: 4955 - RNA, 21 nt, Artificial Sequence
  Synthetic construct
aguuacaacuaauuucacagc

SEQ ID NO: 4956 - RNA, 21 nt, Artificial Sequence
  Synthetic construct
agauaacacauucugacaaaa

SEQ ID NO: 4957 - RNA, 21 nt, Artificial Sequence
  Synthetic construct
uccaauacaaaugcagaaaaa

SEQ ID NO: 4958 - RNA, 21 nt, Artificial Sequence
  Synthetic construct
agcucauguauuucugguugu

SEQ ID NO: 4959 - RNA, 21 nt, Artificial Sequence
  Synthetic construct
ucccaggauuucauugaauuu

SEQ ID NO: 4960 - RNA, 21 nt, Artificial Sequence
  Synthetic construct
cgcucuuucuccuucuucuua

SEQ ID NO: 4961 - RNA, 21 nt, Artificial Sequence
  Synthetic construct
acaggaaaggagaagcucaag

SEQ ID NO: 4962 - RNA, 21 nt, Artificial Sequence
  Synthetic construct
agaauaaacuguuaacaaucu

SEQ ID NO: 4963 - RNA, 21 nt, Artificial Sequence
  Synthetic construct
cacaggaaaggagaagcucaa

SEQ ID NO: 4964 - RNA, 21 nt, Artificial Sequence
  Synthetic construct
uuccuccugguaugccuauuu

SEQ ID NO: 4965 - RNA, 21 nt, Artificial Sequence
  Synthetic construct
caucuuuccugcagcagaguu

SEQ ID NO: 4966 - RNA, 21 nt, Artificial Sequence
  Synthetic construct
cuaggcuaguauuuaucccac

SEQ ID NO: 4967 - RNA, 21 nt, Artificial Sequence
  Synthetic construct
agaagaauccuaccugaauga

SEQ ID NO: 4968 - RNA, 21 nt, Artificial Sequence
  Synthetic construct
acccuaacacaacugauuuca

SEQ ID NO: 4969 - RNA, 21 nt, Artificial Sequence
  Synthetic construct
acucucagaagauucaggaag

SEQ ID NO: 4970 - RNA, 21 nt, Artificial Sequence
  Synthetic construct
agagaucucugggcgcucuuu

SEQ ID NO: 4971 - RNA, 21 nt, Artificial Sequence
  Synthetic construct
aaauaucauuuauagacaaau

SEQ ID NO: 4972 - RNA, 21 nt, Artificial Sequence
  Synthetic construct
ucccaaugcauguuggguuau

SEQ ID NO: 4973 - RNA, 21 nt, Artificial Sequence
  Synthetic construct
guucuaauagugacaucuccc

SEQ ID NO: 4974 - RNA, 21 nt, Artificial Sequence
  Synthetic construct
auauccuguuggacaagaaaa

SEQ ID NO: 4975 - RNA, 21 nt, Artificial Sequence
  Synthetic construct
auuauagaaucucucagaacu

SEQ ID NO: 4976 - RNA, 21 nt, Artificial Sequence
  Synthetic construct
ucaggcuuacaaauaaauuac

SEQ ID NO: 4977 - RNA, 21 nt, Artificial Sequence
  Synthetic construct
aucucugggcgcucuuucucc

SEQ ID NO: 4978 - RNA, 21 nt, Artificial Sequence
  Synthetic construct
cucucucauuagagcagugug

SEQ ID NO: 4979 - RNA, 21 nt, Artificial Sequence
  Synthetic construct
cucaggugauccgccugccuu

SEQ ID NO: 4980 - RNA, 21 nt, Artificial Sequence
  Synthetic construct
aggagugaucugggcacagaa

SEQ ID NO: 4981 - RNA, 21 nt, Artificial Sequence
  Synthetic construct
auuucccggcacuaugaguga

SEQ ID NO: 4982 - RNA, 21 nt, Artificial Sequence
  Synthetic construct
ccaaucuaaagcaaccacaaa

SEQ ID NO: 4983 - RNA, 21 nt, Artificial Sequence
  Synthetic construct
cuaagaucuccucaucuguca

SEQ ID NO: 4984 - RNA, 21 nt, Artificial Sequence
  Synthetic construct
uggaggugauaucucaguucc

SEQ ID NO: 4985 - RNA, 21 nt, Artificial Sequence
  Synthetic construct
cuuccacauguucacacagua

SEQ ID NO: 4986 - RNA, 21 nt, Artificial Sequence
  Synthetic construct
agauggauggauguaccuugg

SEQ ID NO: 4987 - RNA, 21 nt, Artificial Sequence
  Synthetic construct
acugcugguauuaugggauag

SEQ ID NO: 4988 - RNA, 21 nt, Artificial Sequence
  Synthetic construct
ugcucuggucuuggugcgaua

SEQ ID NO: 4989 - RNA, 21 nt, Artificial Sequence
  Synthetic construct
aauaucucaaacuaucaaaac

SEQ ID NO: 4990 - RNA, 21 nt, Artificial Sequence
  Synthetic construct
aacucuauuagggcauggacu

SEQ ID NO: 4991 - RNA, 21 nt, Artificial Sequence
  Synthetic construct
gaauauuaacugcaaguagcu

SEQ ID NO: 4992 - RNA, 21 nt, Artificial Sequence
  Synthetic construct
ccauaaauaccuuuaauccaa

SEQ ID NO: 4993 - RNA, 21 nt, Artificial Sequence
  Synthetic construct
aaggaucaggugguuaaacuc

SEQ ID NO: 4994 - RNA, 21 nt, Artificial Sequence
  Synthetic construct
cucucugcagacagcugcuau

SEQ ID NO: 4995 - RNA, 21 nt, Artificial Sequence
  Synthetic construct
gagggagugugcaucuuugag

SEQ ID NO: 4996 - RNA, 21 nt, Artificial Sequence
  Synthetic construct
ucuuaucaucaauaaugaaua

SEQ ID NO: 4997 - RNA, 21 nt, Artificial Sequence
  Synthetic construct
uaaugaauagggcuuccuaac

SEQ ID NO: 4998 - RNA, 21 nt, Artificial Sequence
  Synthetic construct
ccuaggcuaguauuuauccca

SEQ ID NO: 4999 - RNA, 21 nt, Artificial Sequence
  Synthetic construct
aacuuucuguaauuuacaaaa

SEQ ID NO: 5000 - RNA, 21 nt, Artificial Sequence
  Synthetic construct
auugagcaaaggaauauaauu

SEQ ID NO: 5001 - RNA, 21 nt, Artificial Sequence
  Synthetic construct
auucugauaaacaaugaaaac

SEQ ID NO: 5002 - RNA, 21 nt, Artificial Sequence
  Synthetic construct
aggcagagacaguccuacaua

SEQ ID NO: 5003 - RNA, 21 nt, Artificial Sequence
  Synthetic construct
acacaggugugcacauggagg

SEQ ID NO: 5004 - RNA, 21 nt, Artificial Sequence
  Synthetic construct
auuagggcauggacuuccaca

SEQ ID NO: 5005 - RNA, 21 nt, Artificial Sequence
  Synthetic construct
gaccaagagauucaaccgggg

SEQ ID NO: 5006 - RNA, 21 nt, Artificial Sequence
  Synthetic construct
agaaaugcuaucuuugguucc

SEQ ID NO: 5007 - RNA, 21 nt, Artificial Sequence
  Synthetic construct
guaaguguuuagguucacucu

SEQ ID NO: 5008 - RNA, 21 nt, Artificial Sequence
  Synthetic construct
agcaugaacacaccauauucc

SEQ ID NO: 5009 - RNA, 21 nt, Artificial Sequence
  Synthetic construct
ccaacagaaagauuauaucaa

SEQ ID NO: 5010 - RNA, 21 nt, Artificial Sequence
  Synthetic construct
accugaaugauauacaguaau

SEQ ID NO: 5011 - RNA, 21 nt, Artificial Sequence
  Synthetic construct
aagggaugcuaacuaaugaau

SEQ ID NO: 5012 - RNA, 21 nt, Artificial Sequence
  Synthetic construct
cacaggugugcacauggaggu

SEQ ID NO: 5013 - RNA, 21 nt, Artificial Sequence
  Synthetic construct
cuucucaacauguaagggaug

SEQ ID NO: 5014 - RNA, 21 nt, Artificial Sequence
  Synthetic construct
ugcugguauuaugggauagca

SEQ ID NO: 5015 - RNA, 21 nt, Artificial Sequence
  Synthetic construct
cuggagagaauuucaagacau

SEQ ID NO: 5016 - RNA, 21 nt, Artificial Sequence
  Synthetic construct
gaagaauccuaccugaaugau

SEQ ID NO: 5017 - RNA, 21 nt, Artificial Sequence
  Synthetic construct
auguaaagcucauguauuucu

SEQ ID NO: 5018 - RNA, 21 nt, Artificial Sequence
  Synthetic construct
auaguaugcuucaaauuaaua

SEQ ID NO: 5019 - RNA, 21 nt, Artificial Sequence
  Synthetic construct
auggugaaauaguagucaaau

SEQ ID NO: 5020 - RNA, 21 nt, Artificial Sequence
  Synthetic construct
gucucugugaccacaucaguc

SEQ ID NO: 5021 - RNA, 21 nt, Artificial Sequence
  Synthetic construct
gcaugaacacaccauauuccg

SEQ ID NO: 5022 - RNA, 21 nt, Artificial Sequence
  Synthetic construct
cuugguacaaagugguaguaa

SEQ ID NO: 5023 - RNA, 21 nt, Artificial Sequence
  Synthetic construct
caugggcucugcuaucuugug

SEQ ID NO: 5024 - RNA, 21 nt, Artificial Sequence
  Synthetic construct
gccuauguaacugaucucuuu

SEQ ID NO: 5025 - RNA, 21 nt, Artificial Sequence
  Synthetic construct
aaagagaauaaacuguuaaca

SEQ ID NO: 5026 - RNA, 21 nt, Artificial Sequence
  Synthetic construct
aguuagacauuguuuaauauu

SEQ ID NO: 5027 - RNA, 21 nt, Artificial Sequence
  Synthetic construct
acccaccaaguagcuaucuaa

SEQ ID NO: 5028 - RNA, 21 nt, Artificial Sequence
  Synthetic construct
gaugcuaacuaaugaauaggg

SEQ ID NO: 5029 - RNA, 21 nt, Artificial Sequence
  Synthetic construct
cuauuccuaacucaggacauu

SEQ ID NO: 5030 - RNA, 21 nt, Artificial Sequence
  Synthetic construct
aggaaguuauccuuugguuag

SEQ ID NO: 5031 - RNA, 21 nt, Artificial Sequence
  Synthetic construct
auggugagguguaaggcuugc

SEQ ID NO: 5032 - RNA, 21 nt, Artificial Sequence
  Synthetic construct
ucugggcgcucuuucuccuuc

SEQ ID NO: 5033 - RNA, 21 nt, Artificial Sequence
  Synthetic construct
agcucaccacaaccuccgccu

SEQ ID NO: 5034 - RNA, 21 nt, Artificial Sequence
  Synthetic construct
ucaguuagacauuguuuaaua

SEQ ID NO: 5035 - RNA, 21 nt, Artificial Sequence
  Synthetic construct
cagucuuuguccauaugcauu

SEQ ID NO: 5036 - RNA, 21 nt, Artificial Sequence
  Synthetic construct
uucauccucaguggaggagcc

SEQ ID NO: 5037 - RNA, 21 nt, Artificial Sequence
  Synthetic construct
acuguaaaugaauuggaaggc

SEQ ID NO: 5038 - RNA, 21 nt, Artificial Sequence
  Synthetic construct
aguaaaugaugauuaauguau

SEQ ID NO: 5039 - RNA, 21 nt, Artificial Sequence
  Synthetic construct
aguaauaaagcucauauuaga

SEQ ID NO: 5040 - RNA, 21 nt, Artificial Sequence
  Synthetic construct
uccuagguucagaaccugaac

SEQ ID NO: 5041 - RNA, 21 nt, Artificial Sequence
  Synthetic construct
augcuacaaguuguauagaau

SEQ ID NO: 5042 - RNA, 21 nt, Artificial Sequence
  Synthetic construct
gauacaauucugauaaacaau

SEQ ID NO: 5043 - RNA, 21 nt, Artificial Sequence
  Synthetic construct
cagagggcagacaaccuguuu

SEQ ID NO: 5044 - RNA, 21 nt, Artificial Sequence
  Synthetic construct
gcuugcaggcacucucugcag

SEQ ID NO: 5045 - RNA, 21 nt, Artificial Sequence
  Synthetic construct
agucaccaccucaggugccau

SEQ ID NO: 5046 - RNA, 21 nt, Artificial Sequence
  Synthetic construct
cugcccugcaugcucugcgcu

SEQ ID NO: 5047 - RNA, 21 nt, Artificial Sequence
  Synthetic construct
gggaccauccacuaacuccca

SEQ ID NO: 5048 - RNA, 21 nt, Artificial Sequence
  Synthetic construct
cauuaguagcuacaggauucu

SEQ ID NO: 5049 - RNA, 21 nt, Artificial Sequence
  Synthetic construct
aggcaauaucugcaacagaug

SEQ ID NO: 5050 - RNA, 21 nt, Artificial Sequence
  Synthetic construct
aggauuaauuuagguaucauu

SEQ ID NO: 5051 - RNA, 21 nt, Artificial Sequence
  Synthetic construct
gauucaaccacagaacgagua

SEQ ID NO: 5052 - RNA, 21 nt, Artificial Sequence
  Synthetic construct
caucacauuggguaaggaguu

SEQ ID NO: 5053 - RNA, 21 nt, Artificial Sequence
  Synthetic construct
uguugacuguuucuuuggaau

SEQ ID NO: 5054 - RNA, 21 nt, Artificial Sequence
  Synthetic construct
acaaaugcugaauuucagucc

SEQ ID NO: 5055 - RNA, 21 nt, Artificial Sequence
  Synthetic construct
ugaguauaaucccaguagaca

SEQ ID NO: 5056 - RNA, 21 nt, Artificial Sequence
  Synthetic construct
ugugcugaguucacuucaaau

SEQ ID NO: 5057 - RNA, 21 nt, Artificial Sequence
  Synthetic construct
accacccuaacacaacugauu

SEQ ID NO: 5058 - RNA, 21 nt, Artificial Sequence
  Synthetic construct
cuacucucagaagauucagga

SEQ ID NO: 5059 - RNA, 21 nt, Artificial Sequence
  Synthetic construct
caaagcuugcaggcacucucu

SEQ ID NO: 5060 - RNA, 21 nt, Artificial Sequence
  Synthetic construct
gaaacaacuuucuguaauuua

SEQ ID NO: 5061 - RNA, 21 nt, Artificial Sequence
  Synthetic construct
uuuaaugaggaagacuuccug

SEQ ID NO: 5062 - RNA, 21 nt, Artificial Sequence
  Synthetic construct
ucaauucucaacgucuuccug

SEQ ID NO: 5063 - RNA, 21 nt, Artificial Sequence
  Synthetic construct
uuguuuaagaaugaugacgau

SEQ ID NO: 5064 - RNA, 21 nt, Artificial Sequence
  Synthetic construct
uaaucugauugcaucucaggg

SEQ ID NO: 5065 - RNA, 21 nt, Artificial Sequence
  Synthetic construct
uuagacuugaagcaaugacau

SEQ ID NO: 5066 - RNA, 21 nt, Artificial Sequence
  Synthetic construct
uuaaugaggaagacuuccuga

SEQ ID NO: 5067 - RNA, 21 nt, Artificial Sequence
  Synthetic construct
uaauucaauauacauucacua

SEQ ID NO: 5068 - RNA, 21 nt, Artificial Sequence
  Synthetic construct
uauggaaauuuauuccuccug

SEQ ID NO: 5069 - RNA, 21 nt, Artificial Sequence
  Synthetic construct
aacgaaacuaaauacaagcug

SEQ ID NO: 5070 - RNA, 21 nt, Artificial Sequence
  Synthetic construct
uagaguggagguucugaggag

SEQ ID NO: 5071 - RNA, 21 nt, Artificial Sequence
  Synthetic construct
augcuugcuacgcuuaaucug

SEQ ID NO: 5072 - RNA, 21 nt, Artificial Sequence
  Synthetic construct
uguagcaacaucuccaauugu

SEQ ID NO: 5073 - RNA, 21 nt, Artificial Sequence
  Synthetic construct
uaggagucaaggucggaguug

SEQ ID NO: 5074 - RNA, 21 nt, Artificial Sequence
  Synthetic construct
uuaaucugauugcaucucagg

SEQ ID NO: 5075 - RNA, 21 nt, Artificial Sequence
  Synthetic construct
uaaugaggaagacuuccugag

SEQ ID NO: 5076 - RNA, 21 nt, Artificial Sequence
  Synthetic construct
uaaggcaggagacuaauucaa

SEQ ID NO: 5077 - RNA, 21 nt, Artificial Sequence
  Synthetic construct
auccguaguccuuccagccgg

SEQ ID NO: 5078 - RNA, 21 nt, Artificial Sequence
  Synthetic construct
uagacuugaagcaaugacauc

SEQ ID NO: 5079 - RNA, 21 nt, Artificial Sequence
  Synthetic construct
uguaaggucaauucucaacgu

SEQ ID NO: 5080 - RNA, 21 nt, Artificial Sequence
  Synthetic construct
aacaucuccaauuguacagug

SEQ ID NO: 5081 - RNA, 21 nt, Artificial Sequence
  Synthetic construct
uauaugaagaaauucagagca

SEQ ID NO: 5082 - RNA, 21 nt, Artificial Sequence
  Synthetic construct
aaucugauugcaucucaggga

SEQ ID NO: 5083 - RNA, 21 nt, Artificial Sequence
  Synthetic construct
ucaauauacauucacuaugca

SEQ ID NO: 5084 - RNA, 21 nt, Artificial Sequence
  Synthetic construct
acuaaauacaagcugcuccag

SEQ ID NO: 5085 - RNA, 21 nt, Artificial Sequence
  Synthetic construct
aauucuacaaguucugggcua

SEQ ID NO: 5086 - RNA, 21 nt, Artificial Sequence
  Synthetic construct
uuggucugcaaaucaaaguca

SEQ ID NO: 5087 - RNA, 21 nt, Artificial Sequence
  Synthetic construct
ugcagaauucuacaaguucug

SEQ ID NO: 5088 - RNA, 21 nt, Artificial Sequence
  Synthetic construct
ugaagcaaugacaucuauuaa

SEQ ID NO: 5089 - RNA, 21 nt, Artificial Sequence
  Synthetic construct
uggucugcaaaucaaagucaa

SEQ ID NO: 5090 - RNA, 21 nt, Artificial Sequence
  Synthetic construct
uuauggaaauuuauuccuccu

SEQ ID NO: 5091 - RNA, 21 nt, Artificial Sequence
  Synthetic construct
uauacauucacuaugcagaau

SEQ ID NO: 5092 - RNA, 21 nt, Artificial Sequence
  Synthetic construct
ucacuaugcagaauucuacaa

SEQ ID NO: 5093 - RNA, 21 nt, Artificial Sequence
  Synthetic construct
uugcaucucagggaccuguag

SEQ ID NO: 5094 - RNA, 21 nt, Artificial Sequence
  Synthetic construct
aggaugaccacagcacacccg

SEQ ID NO: 5095 - RNA, 21 nt, Artificial Sequence
  Synthetic construct
uaaagugaaaggcuccuguga

SEQ ID NO: 5096 - RNA, 21 nt, Artificial Sequence
  Synthetic construct
aagaaugaugacgauaucuug

SEQ ID NO: 5097 - RNA, 21 nt, Artificial Sequence
  Synthetic construct
auagacacagaggaaaggcag

SEQ ID NO: 5098 - RNA, 21 nt, Artificial Sequence
  Synthetic construct
ugaagaaauucagagcaucag

SEQ ID NO: 5099 - RNA, 21 nt, Artificial Sequence
  Synthetic construct
ugauugcaucucagggaccug

SEQ ID NO: 5100 - RNA, 21 nt, Artificial Sequence
  Synthetic construct
uuaucaggauguuuaaaugug

SEQ ID NO: 5101 - RNA, 21 nt, Artificial Sequence
  Synthetic construct
acuugaagcaaugacaucuau

SEQ ID NO: 5102 - RNA, 21 nt, Artificial Sequence
  Synthetic construct
auaugaagaaauucagagcau

SEQ ID NO: 5103 - RNA, 21 nt, Artificial Sequence
  Synthetic construct
ucggucggucggcaccucggc

SEQ ID NO: 5104 - RNA, 21 nt, Artificial Sequence
  Synthetic construct
auccauagaguggagguucug

SEQ ID NO: 5105 - RNA, 21 nt, Artificial Sequence
  Synthetic construct
aauccagagguccagauccau

SEQ ID NO: 5106 - RNA, 21 nt, Artificial Sequence
  Synthetic construct
ugcaaaucaaagucaacaggg

SEQ ID NO: 5107 - RNA, 21 nt, Artificial Sequence
  Synthetic construct
ucuuccugaaggcagugccca

SEQ ID NO: 5108 - RNA, 21 nt, Artificial Sequence
  Synthetic construct
uacaagcugcuccaggaaccg

SEQ ID NO: 5109 - RNA, 21 nt, Artificial Sequence
  Synthetic construct
uugaagcaaugacaucuauua

SEQ ID NO: 5110 - RNA, 21 nt, Artificial Sequence
  Synthetic construct
aaggucaauucucaacgucuu

SEQ ID NO: 5111 - RNA, 21 nt, Artificial Sequence
  Synthetic construct
auauacauucacuaugcagaa

SEQ ID NO: 5112 - RNA, 21 nt, Artificial Sequence
  Synthetic construct
ucaacgucuuccugaaggcag

SEQ ID NO: 5113 - RNA, 21 nt, Artificial Sequence
  Synthetic construct
aagccgaauccagagguccag

SEQ ID NO: 5114 - RNA, 21 nt, Artificial Sequence
  Synthetic construct
augaggaagacuuccugagga

SEQ ID NO: 5115 - RNA, 21 nt, Artificial Sequence
  Synthetic construct
aucacauccuuuaaugaggaa

SEQ ID NO: 5116 - RNA, 21 nt, Artificial Sequence
  Synthetic construct
uccugcggauccguaguccuu

SEQ ID NO: 5117 - RNA, 21 nt, Artificial Sequence
  Synthetic construct
uuggaaggagcucagccuccu

SEQ ID NO: 5118 - RNA, 21 nt, Artificial Sequence
  Synthetic construct
auagaguggagguucugagga

SEQ ID NO: 5119 - RNA, 21 nt, Artificial Sequence
  Synthetic construct
aaucaaagucaacagggccag

SEQ ID NO: 5120 - RNA, 21 nt, Artificial Sequence
  Synthetic construct
aaauacaagcugcuccaggaa

SEQ ID NO: 5121 - RNA, 21 nt, Artificial Sequence
  Synthetic construct
ucagucggucggucggcaccu

SEQ ID NO: 5122 - RNA, 21 nt, Artificial Sequence
  Synthetic construct
acaagcugcuccaggaaccgu

SEQ ID NO: 5123 - RNA, 21 nt, Artificial Sequence
  Synthetic construct
ugaggaagacuuccugaggag

SEQ ID NO: 5124 - RNA, 21 nt, Artificial Sequence
  Synthetic construct
aaagugaaccucagaacccca

SEQ ID NO: 5125 - RNA, 21 nt, Artificial Sequence
  Synthetic construct
caauuguacaguguaagccaa

SEQ ID NO: 5126 - RNA, 21 nt, Artificial Sequence
  Synthetic construct
accucggcgaagcuugucggg

SEQ ID NO: 5127 - RNA, 21 nt, Artificial Sequence
  Synthetic construct
uggaaauuuauuccuccugaa

SEQ ID NO: 5128 - RNA, 21 nt, Artificial Sequence
  Synthetic construct
uaagaaugaugacgauaucuu

SEQ ID NO: 5129 - RNA, 21 nt, Artificial Sequence
  Synthetic construct
uuaagaaugaugacgauaucu

SEQ ID NO: 5130 - RNA, 21 nt, Artificial Sequence
  Synthetic construct
uaaauacaagcugcuccagga

SEQ ID NO: 5131 - RNA, 21 nt, Artificial Sequence
  Synthetic construct
aauuuauuccuccugaaugua

SEQ ID NO: 5132 - RNA, 21 nt, Artificial Sequence
  Synthetic construct
acuaauucaauauacauucac

SEQ ID NO: 5133 - RNA, 21 nt, Artificial Sequence
  Synthetic construct
aacgucuuccugaaggcagug

SEQ ID NO: 5134 - RNA, 21 nt, Artificial Sequence
  Synthetic construct
aacuaaauacaagcugcucca

SEQ ID NO: 5135 - RNA, 21 nt, Artificial Sequence
  Synthetic construct
uccuccugaauguauaaggca

SEQ ID NO: 5136 - RNA, 21 nt, Artificial Sequence
  Synthetic construct
auucaauauacauucacuaug

SEQ ID NO: 5137 - RNA, 21 nt, Artificial Sequence
  Synthetic construct
aauucaauauacauucacuau

SEQ ID NO: 5138 - RNA, 21 nt, Artificial Sequence
  Synthetic construct
uaauagacacagaggaaaggc

SEQ ID NO: 5139 - RNA, 21 nt, Artificial Sequence
  Synthetic construct
uaugcagaauucuacaaguuc

SEQ ID NO: 5140 - RNA, 21 nt, Artificial Sequence
  Synthetic construct
aucuccaauuguacaguguaa

SEQ ID NO: 5141 - RNA, 21 nt, Artificial Sequence
  Synthetic construct
caauauacauucacuaugcag

SEQ ID NO: 5142 - RNA, 21 nt, Artificial Sequence
  Synthetic construct
uugcuacgcuuaaucugauug

SEQ ID NO: 5143 - RNA, 21 nt, Artificial Sequence
  Synthetic construct
cuuaaucugauugcaucucag

SEQ ID NO: 5144 - RNA, 21 nt, Artificial Sequence
  Synthetic construct
uucacuaugcagaauucuaca

SEQ ID NO: 5145 - RNA, 21 nt, Artificial Sequence
  Synthetic construct
accgucaacuuaaagagccau

SEQ ID NO: 5146 - RNA, 21 nt, Artificial Sequence
  Synthetic construct
uuccugcggauccguaguccu

SEQ ID NO: 5147 - RNA, 21 nt, Artificial Sequence
  Synthetic construct
auucucaacgucuuccugaag

SEQ ID NO: 5148 - RNA, 21 nt, Artificial Sequence
  Synthetic construct
ucaagggagaauuggucugca

SEQ ID NO: 5149 - RNA, 21 nt, Artificial Sequence
  Synthetic construct
ugcggauccguaguccuucca

SEQ ID NO: 5150 - RNA, 21 nt, Artificial Sequence
  Synthetic construct
ucugcaaaucaaagucaacag

SEQ ID NO: 5151 - RNA, 21 nt, Artificial Sequence
  Synthetic construct
uugccuuacauuauggaaauu

SEQ ID NO: 5152 - RNA, 21 nt, Artificial Sequence
  Synthetic construct
agcugcuccaggaaccgucaa

SEQ ID NO: 5153 - RNA, 21 nt, Artificial Sequence
  Synthetic construct
aaccgucaacuuaaagagcca

SEQ ID NO: 5154 - RNA, 21 nt, Artificial Sequence
  Synthetic construct
ugcuccaggaaccgucaacuu

SEQ ID NO: 5155 - RNA, 21 nt, Artificial Sequence
  Synthetic construct
ugccucuuccugcggauccgu

SEQ ID NO: 5156 - RNA, 21 nt, Artificial Sequence
  Synthetic construct
accuguagcaacaucuccaau

SEQ ID NO: 5157 - RNA, 21 nt, Artificial Sequence
  Synthetic construct
uccagcuccgacaccaggcgc

SEQ ID NO: 5158 - RNA, 21 nt, Artificial Sequence
  Synthetic construct
ucugcggcuguaggugcgcag

SEQ ID NO: 5159 - RNA, 21 nt, Artificial Sequence
  Synthetic construct
aauucucaacgucuuccugaa

SEQ ID NO: 5160 - RNA, 21 nt, Artificial Sequence
  Synthetic construct
agaaauucagagcaucagcca

SEQ ID NO: 5161 - RNA, 21 nt, Artificial Sequence
  Synthetic construct
uauuccuccugaauguauaag

SEQ ID NO: 5162 - RNA, 21 nt, Artificial Sequence
  Synthetic construct
uggagaacaagggcaguggau

SEQ ID NO: 5163 - RNA, 21 nt, Artificial Sequence
  Synthetic construct
uuaagaauguuguuuaagaau

SEQ ID NO: 5164 - RNA, 21 nt, Artificial Sequence
  Synthetic construct
uaaggucaauucucaacgucu

SEQ ID NO: 5165 - RNA, 21 nt, Artificial Sequence
  Synthetic construct
gaccuguagcaacaucuccaa

SEQ ID NO: 5166 - RNA, 21 nt, Artificial Sequence
  Synthetic construct
ugcagcugcagcacgcggcuc

SEQ ID NO: 5167 - RNA, 21 nt, Artificial Sequence
  Synthetic construct
cagaauucuacaaguucuggg

SEQ ID NO: 5168 - RNA, 21 nt, Artificial Sequence
  Synthetic construct
auguuguuuaagaaugaugac

SEQ ID NO: 5169 - RNA, 21 nt, Artificial Sequence
  Synthetic construct
ugcuugcuacgcuuaaucuga

SEQ ID NO: 5170 - RNA, 21 nt, Artificial Sequence
  Synthetic construct
uucaauauacauucacuaugc

SEQ ID NO: 5171 - RNA, 21 nt, Artificial Sequence
  Synthetic construct
uagcaacaucuccaauuguac

SEQ ID NO: 5172 - RNA, 21 nt, Artificial Sequence
  Synthetic construct
uccaauuguacaguguaagcc

SEQ ID NO: 5173 - RNA, 21 nt, Artificial Sequence
  Synthetic construct
uuauuccuccugaauguauaa

SEQ ID NO: 5174 - RNA, 21 nt, Artificial Sequence
  Synthetic construct
uucuugaggcgcgacccguga

SEQ ID NO: 5175 - RNA, 21 nt, Artificial Sequence
  Synthetic construct
uguuguuuaagaaugaugacg

SEQ ID NO: 5176 - RNA, 21 nt, Artificial Sequence
  Synthetic construct
aaagugaaaggcuccugugag

SEQ ID NO: 5177 - RNA, 21 nt, Artificial Sequence
  Synthetic construct
aaaucaaagucaacagggcca

SEQ ID NO: 5178 - RNA, 21 nt, Artificial Sequence
  Synthetic construct
agaauguuguuuaagaaugau

SEQ ID NO: 5179 - RNA, 21 nt, Artificial Sequence
  Synthetic construct
uggagguucugaggaguugga

SEQ ID NO: 5180 - RNA, 21 nt, Artificial Sequence
  Synthetic construct
acauuauggaaauuuauuccu

SEQ ID NO: 5181 - RNA, 21 nt, Artificial Sequence
  Synthetic construct
aucugauugcaucucagggac

SEQ ID NO: 5182 - RNA, 21 nt, Artificial Sequence
  Synthetic construct
uaugaagaaauucagagcauc

SEQ ID NO: 5183 - RNA, 21 nt, Artificial Sequence
  Synthetic construct
uuacauuauggaaauuuauuc

SEQ ID NO: 5184 - RNA, 21 nt, Artificial Sequence
  Synthetic construct
aaugaugacgauaucuugaaa

SEQ ID NO: 5185 - RNA, 21 nt, Artificial Sequence
  Synthetic construct
acaucuccaauuguacagugu

SEQ ID NO: 5186 - RNA, 21 nt, Artificial Sequence
  Synthetic construct
uggaggucagcgcugcgggga

SEQ ID NO: 5187 - RNA, 21 nt, Artificial Sequence
  Synthetic construct
gaaauucagagcaucagccag

SEQ ID NO: 5188 - RNA, 21 nt, Artificial Sequence
  Synthetic construct
uccaccuccagcagccgccgc

SEQ ID NO: 5189 - RNA, 21 nt, Artificial Sequence
  Synthetic construct
ucuugaggcgcgacccgugag

SEQ ID NO: 5190 - RNA, 21 nt, Artificial Sequence
  Synthetic construct
ugcauuugccuuacauuaugg

SEQ ID NO: 5191 - RNA, 21 nt, Artificial Sequence
  Synthetic construct
augcauuugccuuacauuaug

SEQ ID NO: 5192 - RNA, 21 nt, Artificial Sequence
  Synthetic construct
uacauuauggaaauuuauucc

SEQ ID NO: 5193 - RNA, 21 nt, Artificial Sequence
  Synthetic construct
uguaaagugaaaggcuccugu

SEQ ID NO: 5194 - RNA, 21 nt, Artificial Sequence
  Synthetic construct
uccguaguccuuccagccggc

SEQ ID NO: 5195 - RNA, 21 nt, Artificial Sequence
  Synthetic construct
aaacgaaacuaaauacaagcu

SEQ ID NO: 5196 - RNA, 21 nt, Artificial Sequence
  Synthetic construct
ucuccaauuguacaguguaag

SEQ ID NO: 5197 - RNA, 21 nt, Artificial Sequence
  Synthetic construct
uccgcgaucagucggucgguc

SEQ ID NO: 5198 - RNA, 21 nt, Artificial Sequence
  Synthetic construct
uggaaggagcucagccuccuc

SEQ ID NO: 5199 - RNA, 21 nt, Artificial Sequence
  Synthetic construct
auaauagacacagaggaaagg

SEQ ID NO: 5200 - RNA, 21 nt, Artificial Sequence
  Synthetic construct
auggaaauuuauuccuccuga

SEQ ID NO: 5201 - RNA, 21 nt, Artificial Sequence
  Synthetic construct
ucuuccugcggauccguaguc

SEQ ID NO: 5202 - RNA, 21 nt, Artificial Sequence
  Synthetic construct
auugcaucucagggaccugua

SEQ ID NO: 5203 - RNA, 21 nt, Artificial Sequence
  Synthetic construct
uccugaauguauaaggcagga

SEQ ID NO: 5204 - RNA, 21 nt, Artificial Sequence
  Synthetic construct
uucucaacgucuuccugaagg

SEQ ID NO: 5205 - RNA, 21 nt, Artificial Sequence
  Synthetic construct
agaaugaugacgauaucuuga

SEQ ID NO: 5206 - RNA, 21 nt, Artificial Sequence
  Synthetic construct
auuaucaggauguuuaaaugu

SEQ ID NO: 5207 - RNA, 21 nt, Artificial Sequence
  Synthetic construct
uccgucaucacauccuuuaau

SEQ ID NO: 5208 - RNA, 21 nt, Artificial Sequence
  Synthetic construct
cacccgaacagcuagacacgg

SEQ ID NO: 5209 - RNA, 21 nt, Artificial Sequence
  Synthetic construct
aauagacacagaggaaaggca

SEQ ID NO: 5210 - RNA, 21 nt, Artificial Sequence
  Synthetic construct
uccuuuaaugaggaagacuuc

SEQ ID NO: 5211 - RNA, 21 nt, Artificial Sequence
  Synthetic construct
guaaggucaauucucaacguc

SEQ ID NO: 5212 - RNA, 21 nt, Artificial Sequence
  Synthetic construct
uucuacaaguucugggcuaug

SEQ ID NO: 5213 - RNA, 21 nt, Artificial Sequence
  Synthetic construct
augcagaauucuacaaguucu

SEQ ID NO: 5214 - RNA, 21 nt, Artificial Sequence
  Synthetic construct
ucccucaaacaggccucccgg

SEQ ID NO: 5215 - RNA, 21 nt, Artificial Sequence
  Synthetic construct
uuccugaaggcagugcccagg

SEQ ID NO: 5216 - RNA, 21 nt, Artificial Sequence
  Synthetic construct
guagcaacaucuccaauugua

SEQ ID NO: 5217 - RNA, 21 nt, Artificial Sequence
  Synthetic construct
uuuauuccuccugaauguaua

SEQ ID NO: 5218 - RNA, 21 nt, Artificial Sequence
  Synthetic construct
auucacuaugcagaauucuac

SEQ ID NO: 5219 - RNA, 21 nt, Artificial Sequence
  Synthetic construct
acauucacuaugcagaauucu

SEQ ID NO: 5220 - RNA, 21 nt, Artificial Sequence
  Synthetic construct
uacgcuuaaucugauugcauc

SEQ ID NO: 5221 - RNA, 21 nt, Artificial Sequence
  Synthetic construct
caauucucaacgucuuccuga

SEQ ID NO: 5222 - RNA, 21 nt, Artificial Sequence
  Synthetic construct
uccgacaccaggcgccggcgg

SEQ ID NO: 5223 - RNA, 21 nt, Artificial Sequence
  Synthetic construct
cacagcacacccgaacagcua

SEQ ID NO: 5224 - RNA, 21 nt, Artificial Sequence
  Synthetic construct
ucccacguggagaacaagggc

SEQ ID NO: 5225 - RNA, 21 nt, Artificial Sequence
  Synthetic construct
aaugaggaagacuuccugagg

SEQ ID NO: 5226 - RNA, 21 nt, Artificial Sequence
  Synthetic construct
acaagcacacucccacgugga

SEQ ID NO: 5227 - RNA, 21 nt, Artificial Sequence
  Synthetic construct
uccagauccauagaguggagg

SEQ ID NO: 5228 - RNA, 21 nt, Artificial Sequence
  Synthetic construct
aagaauguuguuuaagaauga

SEQ ID NO: 5229 - RNA, 21 nt, Artificial Sequence
  Synthetic construct
cuaugcagaauucuacaaguu

SEQ ID NO: 5230 - RNA, 21 nt, Artificial Sequence
  Synthetic construct
uuccuccugaauguauaaggc

SEQ ID NO: 5231 - RNA, 21 nt, Artificial Sequence
  Synthetic construct
ugaggaguuggaaggagcuca

SEQ ID NO: 5232 - RNA, 21 nt, Artificial Sequence
  Synthetic construct
uccauagaguggagguucuga

SEQ ID NO: 5233 - RNA, 21 nt, Artificial Sequence
  Synthetic construct
uguuuaagaaugaugacgaua

SEQ ID NO: 5234 - RNA, 21 nt, Artificial Sequence
  Synthetic construct
uuuaagaaugaugacgauauc

SEQ ID NO: 5235 - RNA, 21 nt, Artificial Sequence
  Synthetic construct
auguauaaggcaggagacuaa

SEQ ID NO: 5236 - RNA, 21 nt, Artificial Sequence
  Synthetic construct
cuacgcuuaaucugauugcau

SEQ ID NO: 5237 - RNA, 21 nt, Artificial Sequence
  Synthetic construct
uccugguccucggccgcgccu

SEQ ID NO: 5238 - RNA, 21 nt, Artificial Sequence
  Synthetic construct
acuugcaaagugaaccucaga

SEQ ID NO: 5239 - RNA, 21 nt, Artificial Sequence
  Synthetic construct
auuggucugcaaaucaaaguc

SEQ ID NO: 5240 - RNA, 21 nt, Artificial Sequence
  Synthetic construct
caucucagggaccuguagcaa

SEQ ID NO: 5241 - RNA, 21 nt, Artificial Sequence
  Synthetic construct
ugaggcgcgacccgugagccg

SEQ ID NO: 5242 - RNA, 21 nt, Artificial Sequence
  Synthetic construct
uaggugcgcagggaggaugac

SEQ ID NO: 5243 - RNA, 21 nt, Artificial Sequence
  Synthetic construct
agucggucggucggcaccucg

SEQ ID NO: 5244 - RNA, 21 nt, Artificial Sequence
  Synthetic construct
aaacuaaauacaagcugcucc

SEQ ID NO: 5245 - RNA, 21 nt, Artificial Sequence
  Synthetic construct
cagagguccagauccauagag

SEQ ID NO: 5246 - RNA, 21 nt, Artificial Sequence
  Synthetic construct
uccauuaucaggauguuuaaa

SEQ ID NO: 5247 - RNA, 21 nt, Artificial Sequence
  Synthetic construct
acagcacacccgaacagcuag

SEQ ID NO: 5248 - RNA, 21 nt, Artificial Sequence
  Synthetic construct
uaagaauguuguuuaagaaug

SEQ ID NO: 5249 - RNA, 21 nt, Artificial Sequence
  Synthetic construct
aguuggaaggagcucagccuc

SEQ ID NO: 5250 - RNA, 21 nt, Artificial Sequence
  Synthetic construct
ucaggucaagggagaauuggu

SEQ ID NO: 5251 - RNA, 21 nt, Artificial Sequence
  Synthetic construct
ugcggcuguaggugcgcaggg

SEQ ID NO: 5252 - RNA, 21 nt, Artificial Sequence
  Synthetic construct
uccugugaggagggcgcuggg

SEQ ID NO: 5253 - RNA, 21 nt, Artificial Sequence
  Synthetic construct
ucacauccuuuaaugaggaag

SEQ ID NO: 5254 - RNA, 21 nt, Artificial Sequence
  Synthetic construct
auucuacaaguucugggcuau

SEQ ID NO: 5255 - RNA, 21 nt, Artificial Sequence
  Synthetic construct
auuuauuccuccugaauguau

SEQ ID NO: 5256 - RNA, 21 nt, Artificial Sequence
  Synthetic construct
ucggucggcaccucggcgaag

SEQ ID NO: 5257 - RNA, 21 nt, Artificial Sequence
  Synthetic construct
gaaacuaaauacaagcugcuc

SEQ ID NO: 5258 - RNA, 21 nt, Artificial Sequence
  Synthetic construct
guccgcgaucagucggucggu

SEQ ID NO: 5259 - RNA, 21 nt, Artificial Sequence
  Synthetic construct
ucugaggaguuggaaggagcu

SEQ ID NO: 5260 - RNA, 21 nt, Artificial Sequence
  Synthetic construct
ugaauguauaaggcaggagac

SEQ ID NO: 5261 - RNA, 21 nt, Artificial Sequence
  Synthetic construct
uccaggaaccgucaacuuaaa

SEQ ID NO: 5262 - RNA, 21 nt, Artificial Sequence
  Synthetic construct
uagacacagaggaaaggcagc

SEQ ID NO: 5263 - RNA, 21 nt, Artificial Sequence
  Synthetic construct
agcuccgacaccaggcgccgg

SEQ ID NO: 5264 - RNA, 21 nt, Artificial Sequence
  Synthetic construct
aaauuuauuccuccugaaugu

SEQ ID NO: 5265 - RNA, 21 nt, Artificial Sequence
  Synthetic construct
accucugcucugccguccccu

SEQ ID NO: 5266 - RNA, 21 nt, Artificial Sequence
  Synthetic construct
uugcaaagugaaccucagaac

SEQ ID NO: 5267 - RNA, 21 nt, Artificial Sequence
  Synthetic construct
ugcagcuccugguccucggcc

SEQ ID NO: 5268 - RNA, 21 nt, Artificial Sequence
  Synthetic construct
cuguaaagugaaaggcuccug

SEQ ID NO: 5269 - RNA, 21 nt, Artificial Sequence
  Synthetic construct
ugaaaggcuccugugaggagg

SEQ ID NO: 5270 - RNA, 21 nt, Artificial Sequence
  Synthetic construct
augaugacgauaucuugaaaa

SEQ ID NO: 5271 - RNA, 21 nt, Artificial Sequence
  Synthetic construct
auccuuuaaugaggaagacuu

SEQ ID NO: 5272 - RNA, 21 nt, Artificial Sequence
  Synthetic construct
auuauggaaauuuauuccucc

SEQ ID NO: 5273 - RNA, 21 nt, Artificial Sequence
  Synthetic construct
aauguauaaggcaggagacua

SEQ ID NO: 5274 - RNA, 21 nt, Artificial Sequence
  Synthetic construct
agacuugaagcaaugacaucu

SEQ ID NO: 5275 - RNA, 21 nt, Artificial Sequence
  Synthetic construct
uauaaggcaggagacuaauuc

SEQ ID NO: 5276 - RNA, 21 nt, Artificial Sequence
  Synthetic construct
aggucaauucucaacgucuuc

SEQ ID NO: 5277 - RNA, 21 nt, Artificial Sequence
  Synthetic construct
gaauucuacaaguucugggcu

SEQ ID NO: 5278 - RNA, 21 nt, Artificial Sequence
  Synthetic construct
agaauuggucugcaaaucaaa

SEQ ID NO: 5279 - RNA, 21 nt, Artificial Sequence
  Synthetic construct
caaagugaaccucagaacccc

SEQ ID NO: 5280 - RNA, 21 nt, Artificial Sequence
  Synthetic construct
gagaauuggucugcaaaucaa

SEQ ID NO: 5281 - RNA, 21 nt, Artificial Sequence
  Synthetic construct
aggaaccgucaacuuaaagag

SEQ ID NO: 5282 - RNA, 21 nt, Artificial Sequence
  Synthetic construct
acagaggaaaggcagcaaggg

SEQ ID NO: 5283 - RNA, 21 nt, Artificial Sequence
  Synthetic construct
cugcaaaucaaagucaacagg

SEQ ID NO: 5284 - RNA, 21 nt, Artificial Sequence
  Synthetic construct
ucagggaccuguagcaacauc

SEQ ID NO: 5285 - RNA, 21 nt, Artificial Sequence
  Synthetic construct
ucaucacauccuuuaaugagg

SEQ ID NO: 5286 - RNA, 21 nt, Artificial Sequence
  Synthetic construct
cagacuaucuuucugaggggc

SEQ ID NO: 5287 - RNA, 21 nt, Artificial Sequence
  Synthetic construct
uuugccuuacauuauggaaau

SEQ ID NO: 5288 - RNA, 21 nt, Artificial Sequence
  Synthetic construct
agaauucuacaaguucugggc

SEQ ID NO: 5289 - RNA, 21 nt, Artificial Sequence
  Synthetic construct
gauccguaguccuuccagccg

SEQ ID NO: 5290 - RNA, 21 nt, Artificial Sequence
  Synthetic construct
uacauucacuaugcagaauuc

SEQ ID NO: 5291 - RNA, 21 nt, Artificial Sequence
  Synthetic construct
agcagacuaucuuucugaggg

SEQ ID NO: 5292 - RNA, 21 nt, Artificial Sequence
  Synthetic construct
cugugagucaggucaagggag

SEQ ID NO: 5293 - RNA, 21 nt, Artificial Sequence
  Synthetic construct
acuguaaagugaaaggcuccu

SEQ ID NO: 5294 - RNA, 21 nt, Artificial Sequence
  Synthetic construct
gacuugaagcaaugacaucua

SEQ ID NO: 5295 - RNA, 21 nt, Artificial Sequence
  Synthetic construct
cacuugcaaagugaaccucag

SEQ ID NO: 5296 - RNA, 21 nt, Artificial Sequence
  Synthetic construct
cagauccauagaguggagguu

SEQ ID NO: 5297 - RNA, 21 nt, Artificial Sequence
  Synthetic construct
cucaacgucuuccugaaggca

SEQ ID NO: 5298 - RNA, 21 nt, Artificial Sequence
  Synthetic construct
agguccagauccauagagugg

SEQ ID NO: 5299 - RNA, 21 nt, Artificial Sequence
  Synthetic construct
gucaucacauccuuuaaugag

SEQ ID NO: 5300 - RNA, 21 nt, Artificial Sequence
  Synthetic construct
agcucagccuccucuacuggg

SEQ ID NO: 5301 - RNA, 21 nt, Artificial Sequence
  Synthetic construct
agaacaagggcaguggaugaa

SEQ ID NO: 5302 - RNA, 21 nt, Artificial Sequence
  Synthetic construct
gcagacuaucuuucugagggg

SEQ ID NO: 5303 - RNA, 21 nt, Artificial Sequence
  Synthetic construct
ucagccuccucuacugggccc

SEQ ID NO: 5304 - RNA, 21 nt, Artificial Sequence
  Synthetic construct
caucuccaauuguacagugua

SEQ ID NO: 5305 - RNA, 21 nt, Artificial Sequence
  Synthetic construct
cagucggucggucggcaccuc

SEQ ID NO: 5306 - RNA, 21 nt, Artificial Sequence
  Synthetic construct
guaggagucaaggucggaguu

SEQ ID NO: 5307 - RNA, 21 nt, Artificial Sequence
  Synthetic construct
aaggcagcaagggcacuugca

SEQ ID NO: 5308 - RNA, 21 nt, Artificial Sequence
  Synthetic construct
aauauacauucacuaugcaga

SEQ ID NO: 5309 - RNA, 21 nt, Artificial Sequence
  Synthetic construct
uaguccuuccagccggcgucc

SEQ ID NO: 5310 - RNA, 21 nt, Artificial Sequence
  Synthetic construct
agcaagggcacuugcaaagug

SEQ ID NO: 5311 - RNA, 21 nt, Artificial Sequence
  Synthetic construct
aaaggcuccugugaggagggc

SEQ ID NO: 5312 - RNA, 21 nt, Artificial Sequence
  Synthetic construct
ucuccagcuccgacaccaggc

SEQ ID NO: 5313 - RNA, 21 nt, Artificial Sequence
  Synthetic construct
uccucggccgcgccugcugaa

SEQ ID NO: 5314 - RNA, 21 nt, Artificial Sequence
  Synthetic construct
guaaagugaaaggcuccugug

SEQ ID NO: 5315 - RNA, 21 nt, Artificial Sequence
  Synthetic construct
ugguccucggccgcgccugcu

SEQ ID NO: 5316 - RNA, 21 nt, Artificial Sequence
  Synthetic construct
ucucaacgucuuccugaaggc

SEQ ID NO: 5317 - RNA, 21 nt, Artificial Sequence
  Synthetic construct
ucccuccauuaucaggauguu

SEQ ID NO: 5318 - RNA, 21 nt, Artificial Sequence
  Synthetic construct
cauuauggaaauuuauuccuc

SEQ ID NO: 5319 - RNA, 21 nt, Artificial Sequence
  Synthetic construct
auaaggcaggagacuaauuca

SEQ ID NO: 5320 - RNA, 21 nt, Artificial Sequence
  Synthetic construct
ugcuacgcuuaaucugauugc

SEQ ID NO: 5321 - RNA, 21 nt, Artificial Sequence
  Synthetic construct
acauccuuuaaugaggaagac

SEQ ID NO: 5322 - RNA, 21 nt, Artificial Sequence
  Synthetic construct
aauuggucugcaaaucaaagu

SEQ ID NO: 5323 - RNA, 21 nt, Artificial Sequence
  Synthetic construct
gaugaccacagcacacccgaa

SEQ ID NO: 5324 - RNA, 21 nt, Artificial Sequence
  Synthetic construct
accuccagcagccgccgccgu

SEQ ID NO: 5325 - RNA, 21 nt, Artificial Sequence
  Synthetic construct
caagggagaauuggucugcaa

SEQ ID NO: 5326 - RNA, 21 nt, Artificial Sequence
  Synthetic construct
ugcggcggaagggcgagucgg

SEQ ID NO: 5327 - RNA, 21 nt, Artificial Sequence
  Synthetic construct
aguucuccagaaccagccccu

SEQ ID NO: 5328 - RNA, 21 nt, Artificial Sequence
  Synthetic construct
ucaggcucuccgcgcggugcg

SEQ ID NO: 5329 - RNA, 21 nt, Artificial Sequence
  Synthetic construct
uguauaaggcaggagacuaau

SEQ ID NO: 5330 - RNA, 21 nt, Artificial Sequence
  Synthetic construct
ugugagucaggucaagggaga

SEQ ID NO: 5331 - RNA, 21 nt, Artificial Sequence
  Synthetic construct
caacaucuccaauuguacagu

SEQ ID NO: 5332 - RNA, 21 nt, Artificial Sequence
  Synthetic construct
uccuuccagccggcguccgcg

SEQ ID NO: 5333 - RNA, 21 nt, Artificial Sequence
  Synthetic construct
aagaaauucagagcaucagcc

SEQ ID NO: 5334 - RNA, 21 nt, Artificial Sequence
  Synthetic construct
gaccacagcacacccgaacag

SEQ ID NO: 5335 - RNA, 21 nt, Artificial Sequence
  Synthetic construct
aaagccgaauccagaggucca

SEQ ID NO: 5336 - RNA, 21 nt, Artificial Sequence
  Synthetic construct
ucugauugcaucucagggacc

SEQ ID NO: 5337 - RNA, 21 nt, Artificial Sequence
  Synthetic construct
gcaacaucuccaauuguacag

SEQ ID NO: 5338 - RNA, 21 nt, Artificial Sequence
  Synthetic construct
gucaauucucaacgucuuccu

SEQ ID NO: 5339 - RNA, 21 nt, Artificial Sequence
  Synthetic construct
agcuccugguccucggccgcg

SEQ ID NO: 5340 - RNA, 21 nt, Artificial Sequence
  Synthetic construct
acaagggcaguggaugaaggg

SEQ ID NO: 5341 - RNA, 21 nt, Artificial Sequence
  Synthetic construct
aauguuguuuaagaaugauga

SEQ ID NO: 5342 - RNA, 21 nt, Artificial Sequence
  Synthetic construct
agggaccuguagcaacaucuc

SEQ ID NO: 5343 - RNA, 21 nt, Artificial Sequence
  Synthetic construct
uguaggugcgcagggaggaug

SEQ ID NO: 5344 - RNA, 21 nt, Artificial Sequence
  Synthetic construct
guucugaggaguuggaaggag

SEQ ID NO: 5345 - RNA, 21 nt, Artificial Sequence
  Synthetic construct
auacauucacuaugcagaauu

SEQ ID NO: 5346 - RNA, 21 nt, Artificial Sequence
  Synthetic construct
acacccgaacagcuagacacg

SEQ ID NO: 5347 - RNA, 21 nt, Artificial Sequence
  Synthetic construct
cugaggaguuggaaggagcuc

SEQ ID NO: 5348 - RNA, 21 nt, Artificial Sequence
  Synthetic construct
agacacagaggaaaggcagca

SEQ ID NO: 5349 - RNA, 21 nt, Artificial Sequence
  Synthetic construct
agucaaggucggaguuggggg

SEQ ID NO: 5350 - RNA, 21 nt, Artificial Sequence
  Synthetic construct
cuaaauacaagcugcuccagg

SEQ ID NO: 5351 - RNA, 21 nt, Artificial Sequence
  Synthetic construct
agcgcugcagcuccugguccu

SEQ ID NO: 5352 - RNA, 21 nt, Artificial Sequence
  Synthetic construct
uccagagguccagauccauag

SEQ ID NO: 5353 - RNA, 21 nt, Artificial Sequence
  Synthetic construct
acguggagaacaagggcagug

SEQ ID NO: 5354 - RNA, 21 nt, Artificial Sequence
  Synthetic construct
caucacauccuuuaaugagga

SEQ ID NO: 5355 - RNA, 21 nt, Artificial Sequence
  Synthetic construct
cgaaacuaaauacaagcugcu

SEQ ID NO: 5356 - RNA, 21 nt, Artificial Sequence
  Synthetic construct
aguccuuccagccggcguccg

SEQ ID NO: 5357 - RNA, 21 nt, Artificial Sequence
  Synthetic construct
aagugaaaggcuccugugagg

SEQ ID NO: 5358 - RNA, 21 nt, Artificial Sequence
  Synthetic construct
aaggagcucagccuccucuac

SEQ ID NO: 5359 - RNA, 21 nt, Artificial Sequence
  Synthetic construct
aguggagguucugaggaguug

SEQ ID NO: 5360 - RNA, 21 nt, Artificial Sequence
  Synthetic construct
ggaccuguagcaacaucucca

SEQ ID NO: 5361 - RNA, 21 nt, Artificial Sequence
  Synthetic construct
acgcuuaaucugauugcaucu

SEQ ID NO: 5362 - RNA, 21 nt, Artificial Sequence
  Synthetic construct
cucagggaccuguagcaacau

SEQ ID NO: 5363 - RNA, 21 nt, Artificial Sequence
  Synthetic construct
ggcacuugcaaagugaaccuc

SEQ ID NO: 5364 - RNA, 21 nt, Artificial Sequence
  Synthetic construct
caccucggcgaagcuugucgg

SEQ ID NO: 5365 - RNA, 21 nt, Artificial Sequence
  Synthetic construct
aaggcuccugugaggagggcg

SEQ ID NO: 5366 - RNA, 21 nt, Artificial Sequence
  Synthetic construct
ucuacaaguucugggcuaugu

SEQ ID NO: 5367 - RNA, 21 nt, Artificial Sequence
  Synthetic construct
agcugcguccggcagcggcgg

SEQ ID NO: 5368 - RNA, 21 nt, Artificial Sequence
  Synthetic construct
aagcugcuccaggaaccguca

SEQ ID NO: 5369 - RNA, 21 nt, Artificial Sequence
  Synthetic construct
aaugcuugcuacgcuuaaucu

SEQ ID NO: 5370 - RNA, 21 nt, Artificial Sequence
  Synthetic construct
cuugcuacgcuuaaucugauu

SEQ ID NO: 5371 - RNA, 21 nt, Artificial Sequence
  Synthetic construct
aggaagacuuccugaggaggg

SEQ ID NO: 5372 - RNA, 21 nt, Artificial Sequence
  Synthetic construct
ccaauuguacaguguaagcca

SEQ ID NO: 5373 - RNA, 21 nt, Artificial Sequence
  Synthetic construct
cacuaugcagaauucuacaag

SEQ ID NO: 5374 - RNA, 21 nt, Artificial Sequence
  Synthetic construct
cuugaagcaaugacaucuauu

SEQ ID NO: 5375 - RNA, 21 nt, Artificial Sequence
  Synthetic construct
guggaggucagcgcugcgggg

SEQ ID NO: 5376 - RNA, 21 nt, Artificial Sequence
  Synthetic construct
agcaacaucuccaauuguaca

SEQ ID NO: 5377 - RNA, 21 nt, Artificial Sequence
  Synthetic construct
acgaaacuaaauacaagcugc

SEQ ID NO: 5378 - RNA, 21 nt, Artificial Sequence
  Synthetic construct
aagggcgagucgggcucgggg

SEQ ID NO: 5379 - RNA, 21 nt, Artificial Sequence
  Synthetic construct
uaagagcaggcggcugugagu

SEQ ID NO: 5380 - RNA, 21 nt, Artificial Sequence
  Synthetic construct
uccagcagccgccgccgugcu

SEQ ID NO: 5381 - RNA, 21 nt, Artificial Sequence
  Synthetic construct
aagggcaguggaugaagggaa

SEQ ID NO: 5382 - RNA, 21 nt, Artificial Sequence
  Synthetic construct
aguggaugaagggaacgggga

SEQ ID NO: 5383 - RNA, 21 nt, Artificial Sequence
  Synthetic construct
cugauugcaucucagggaccu

SEQ ID NO: 5384 - RNA, 21 nt, Artificial Sequence
  Synthetic construct
auuugccuuacauuauggaaa

SEQ ID NO: 5385 - RNA, 21 nt, Artificial Sequence
  Synthetic construct
aaacaggccucccggcgccgu

SEQ ID NO: 5386 - RNA, 21 nt, Artificial Sequence
  Synthetic construct
ucaaacaggccucccggcgcc

SEQ ID NO: 5387 - RNA, 21 nt, Artificial Sequence
  Synthetic construct
aagcacacucccacguggaga

SEQ ID NO: 5388 - RNA, 21 nt, Artificial Sequence
  Synthetic construct
aagggagaauuggucugcaaa

SEQ ID NO: 5389 - RNA, 21 nt, Artificial Sequence
  Synthetic construct
gaaugaugacgauaucuugaa

SEQ ID NO: 5390 - RNA, 21 nt, Artificial Sequence
  Synthetic construct
uuacaaacauugaacacaggg

SEQ ID NO: 5391 - RNA, 21 nt, Artificial Sequence
  Synthetic construct
uuuacaaacauugaacacagg

SEQ ID NO: 5392 - RNA, 21 nt, Artificial Sequence
  Synthetic construct
uuucuuaaugaacagggccuu

SEQ ID NO: 5393 - RNA, 21 nt, Artificial Sequence
  Synthetic construct
auauuuacacagaacaaucuu

SEQ ID NO: 5394 - RNA, 21 nt, Artificial Sequence
  Synthetic construct
uauuuacacagaacaaucuuu

SEQ ID NO: 5395 - RNA, 21 nt, Artificial Sequence
  Synthetic construct
uaguauaagaaucauaaacaa

SEQ ID NO: 5396 - RNA, 21 nt, Artificial Sequence
  Synthetic construct
uauaaagacauauuuacacag

SEQ ID NO: 5397 - RNA, 21 nt, Artificial Sequence
  Synthetic construct
uacaaacauugaacacagggg

SEQ ID NO: 5398 - RNA, 21 nt, Artificial Sequence
  Synthetic construct
uucaucaagcaacucuacuuu

SEQ ID NO: 5399 - RNA, 21 nt, Artificial Sequence
  Synthetic construct
uaggucuccaaagucagucca

SEQ ID NO: 5400 - RNA, 21 nt, Artificial Sequence
  Synthetic construct
uaucuuuguauaaauuaguau

SEQ ID NO: 5401 - RNA, 21 nt, Artificial Sequence
  Synthetic construct
uuauauugaacucuuugcauu

SEQ ID NO: 5402 - RNA, 21 nt, Artificial Sequence
  Synthetic construct
uugaccuagaaccgauuuggg

SEQ ID NO: 5403 - RNA, 21 nt, Artificial Sequence
  Synthetic construct
auaagaaucauaaacaaccac

SEQ ID NO: 5404 - RNA, 21 nt, Artificial Sequence
  Synthetic construct
ucuugucuucucuuucucccu

SEQ ID NO: 5405 - RNA, 21 nt, Artificial Sequence
  Synthetic construct
uaacuagagucucuccuugcu

SEQ ID NO: 5406 - RNA, 21 nt, Artificial Sequence
  Synthetic construct
uauuagaguacccugggucug

SEQ ID NO: 5407 - RNA, 21 nt, Artificial Sequence
  Synthetic construct
uaucaaauguauuuauugcug

SEQ ID NO: 5408 - RNA, 21 nt, Artificial Sequence
  Synthetic construct
ucuuaacuagagucucuccuu

SEQ ID NO: 5409 - RNA, 21 nt, Artificial Sequence
  Synthetic construct
acaaucuuuacaaacauugaa

SEQ ID NO: 5410 - RNA, 21 nt, Artificial Sequence
  Synthetic construct
uucuucaaaugacacugccaa

SEQ ID NO: 5411 - RNA, 21 nt, Artificial Sequence
  Synthetic construct
uauaagaaucauaaacaacca

SEQ ID NO: 5412 - RNA, 21 nt, Artificial Sequence
  Synthetic construct
aacuagagucucuccuugcuu

SEQ ID NO: 5413 - RNA, 21 nt, Artificial Sequence
  Synthetic construct
auguucuuaaauaaacugcuu

SEQ ID NO: 5414 - RNA, 21 nt, Artificial Sequence
  Synthetic construct
uuuaagcagcagcagcagcag

SEQ ID NO: 5415 - RNA, 21 nt, Artificial Sequence
  Synthetic construct
aacaggacaguucacagccag

SEQ ID NO: 5416 - RNA, 21 nt, Artificial Sequence
  Synthetic construct
uuauggaaccuuccagcccag

SEQ ID NO: 5417 - RNA, 21 nt, Artificial Sequence
  Synthetic construct
uggaggagacauaaccgccgg

SEQ ID NO: 5418 - RNA, 21 nt, Artificial Sequence
  Synthetic construct
aaucauccaaacuacagccag

SEQ ID NO: 5419 - RNA, 21 nt, Artificial Sequence
  Synthetic construct
uuuauuauaaagacauauuua

SEQ ID NO: 5420 - RNA, 21 nt, Artificial Sequence
  Synthetic construct
auaaauuaguauaagaaucau

SEQ ID NO: 5421 - RNA, 21 nt, Artificial Sequence
  Synthetic construct
uauauugaacucuuugcauuu

SEQ ID NO: 5422 - RNA, 21 nt, Artificial Sequence
  Synthetic construct
uucuguuccuuugcuuucuuu

SEQ ID NO: 5423 - RNA, 21 nt, Artificial Sequence
  Synthetic construct
uuaacugagcaaacgcugaug

SEQ ID NO: 5424 - RNA, 21 nt, Artificial Sequence
  Synthetic construct
uacacagaacaaucuuuacaa

SEQ ID NO: 5425 - RNA, 21 nt, Artificial Sequence
  Synthetic construct
uaaagacauauuuacacagaa

SEQ ID NO: 5426 - RNA, 21 nt, Artificial Sequence
  Synthetic construct
acaaacauugaacacagggga

SEQ ID NO: 5427 - RNA, 21 nt, Artificial Sequence
  Synthetic construct
ucuaacauucugugauucuug

SEQ ID NO: 5428 - RNA, 21 nt, Artificial Sequence
  Synthetic construct
ugagccuuuaagcagcagcag

SEQ ID NO: 5429 - RNA, 21 nt, Artificial Sequence
  Synthetic construct
uuaucaaauguauuuauugcu

SEQ ID NO: 5430 - RNA, 21 nt, Artificial Sequence
  Synthetic construct
uauguucuuaaauaaacugcu

SEQ ID NO: 5431 - RNA, 21 nt, Artificial Sequence
  Synthetic construct
uacaaacaaagucauuaucaa

SEQ ID NO: 5432 - RNA, 21 nt, Artificial Sequence
  Synthetic construct
uaaauuaguauaagaaucaua

SEQ ID NO: 5433 - RNA, 21 nt, Artificial Sequence
  Synthetic construct
ucaucaagcaacucuacuuug

SEQ ID NO: 5434 - RNA, 21 nt, Artificial Sequence
  Synthetic construct
uguucuuaaauaaacugcuuu

SEQ ID NO: 5435 - RNA, 21 nt, Artificial Sequence
  Synthetic construct
uugagcgguagucucagugcc

SEQ ID NO: 5436 - RNA, 21 nt, Artificial Sequence
  Synthetic construct
uaagugaccuucaaggguccu

SEQ ID NO: 5437 - RNA, 21 nt, Artificial Sequence
  Synthetic construct
ucuucuguucccuaucuccca

SEQ ID NO: 5438 - RNA, 21 nt, Artificial Sequence
  Synthetic construct
uuacacagaacaaucuuuaca

SEQ ID NO: 5439 - RNA, 21 nt, Artificial Sequence
  Synthetic construct
uuaacuagagucucuccuugc

SEQ ID NO: 5440 - RNA, 21 nt, Artificial Sequence
  Synthetic construct
uucucuuucucccuccuggga

SEQ ID NO: 5441 - RNA, 21 nt, Artificial Sequence
  Synthetic construct
aacaauuucuuaaugaacagg

SEQ ID NO: 5442 - RNA, 21 nt, Artificial Sequence
  Synthetic construct
uauugaacucuuugcauuuua

SEQ ID NO: 5443 - RNA, 21 nt, Artificial Sequence
  Synthetic construct
ucagcucuaacauucugugau

SEQ ID NO: 5444 - RNA, 21 nt, Artificial Sequence
  Synthetic construct
agaaucauaaacaaccacuuu

SEQ ID NO: 5445 - RNA, 21 nt, Artificial Sequence
  Synthetic construct
ugaccuagaaccgauuuggga

SEQ ID NO: 5446 - RNA, 21 nt, Artificial Sequence
  Synthetic construct
uugugagagaacgggaaucau

SEQ ID NO: 5447 - RNA, 21 nt, Artificial Sequence
  Synthetic construct
uucccuuccuucuucuccccu

SEQ ID NO: 5448 - RNA, 21 nt, Artificial Sequence
  Synthetic construct
ucaagcaacucuacuuuguga

SEQ ID NO: 5449 - RNA, 21 nt, Artificial Sequence
  Synthetic construct
uuccugcugcacuuccuccca

SEQ ID NO: 5450 - RNA, 21 nt, Artificial Sequence
  Synthetic construct
aucuuuacaaacauugaacac

SEQ ID NO: 5451 - RNA, 21 nt, Artificial Sequence
  Synthetic construct
uugggaggcacacuaaggcaa

SEQ ID NO: 5452 - RNA, 21 nt, Artificial Sequence
  Synthetic construct
uuguauaaauuaguauaagaa

SEQ ID NO: 5453 - RNA, 21 nt, Artificial Sequence
  Synthetic construct
uuccagcccauucccaucggg

SEQ ID NO: 5454 - RNA, 21 nt, Artificial Sequence
  Synthetic construct
ucuuucuuuccuuccuucugu

SEQ ID NO: 5455 - RNA, 21 nt, Artificial Sequence
  Synthetic construct
auagcagaagacacccaccaa

SEQ ID NO: 5456 - RNA, 21 nt, Artificial Sequence
  Synthetic construct
ucaggcucuugucuucucuuu

SEQ ID NO: 5457 - RNA, 21 nt, Artificial Sequence
  Synthetic construct
uaaacaaccacuuuaaauaag

SEQ ID NO: 5458 - RNA, 21 nt, Artificial Sequence
  Synthetic construct
ugucagcucuaacauucugug

SEQ ID NO: 5459 - RNA, 21 nt, Artificial Sequence
  Synthetic construct
uucuuaaauaaacugcuuuaa

SEQ ID NO: 5460 - RNA, 21 nt, Artificial Sequence
  Synthetic construct
uaauaucuuuguauaaauuag

SEQ ID NO: 5461 - RNA, 21 nt, Artificial Sequence
  Synthetic construct
auggaggagacauaaccgccg

SEQ ID NO: 5462 - RNA, 21 nt, Artificial Sequence
  Synthetic construct
uuaagcauagggauucauuuu

SEQ ID NO: 5463 - RNA, 21 nt, Artificial Sequence
  Synthetic construct
uuaauaucuuuguauaaauua

SEQ ID NO: 5464 - RNA, 21 nt, Artificial Sequence
  Synthetic construct
auauugaacucuuugcauuuu

SEQ ID NO: 5465 - RNA, 21 nt, Artificial Sequence
  Synthetic construct
ucuaccucucccuuaacugag

SEQ ID NO: 5466 - RNA, 21 nt, Artificial Sequence
  Synthetic construct
auaucuuuguauaaauuagua

SEQ ID NO: 5467 - RNA, 21 nt, Artificial Sequence
  Synthetic construct
aucaagcaacucuacuuugug

SEQ ID NO: 5468 - RNA, 21 nt, Artificial Sequence
  Synthetic construct
ucaaauguauuuauugcugaa

SEQ ID NO: 5469 - RNA, 21 nt, Artificial Sequence
  Synthetic construct
uagcagaagacacccaccaag

SEQ ID NO: 5470 - RNA, 21 nt, Artificial Sequence
  Synthetic construct
uccugcugcacuuccucccau

SEQ ID NO: 5471 - RNA, 21 nt, Artificial Sequence
  Synthetic construct
ucucccagcuuucuuagccau

SEQ ID NO: 5472 - RNA, 21 nt, Artificial Sequence
  Synthetic construct
aagaaucauaaacaaccacuu

SEQ ID NO: 5473 - RNA, 21 nt, Artificial Sequence
  Synthetic construct
aucuuucuuuccuuccuucug

SEQ ID NO: 5474 - RNA, 21 nt, Artificial Sequence
  Synthetic construct
auucuugugagagaacgggaa

SEQ ID NO: 5475 - RNA, 21 nt, Artificial Sequence
  Synthetic construct
auuuacacagaacaaucuuua

SEQ ID NO: 5476 - RNA, 21 nt, Artificial Sequence
  Synthetic construct
auucuucaaaugacacugcca

SEQ ID NO: 5477 - RNA, 21 nt, Artificial Sequence
  Synthetic construct
uugucuucucuuucucccucc

SEQ ID NO: 5478 - RNA, 21 nt, Artificial Sequence
  Synthetic construct
ucaggcuaucucauucaucaa

SEQ ID NO: 5479 - RNA, 21 nt, Artificial Sequence
  Synthetic construct
uucuuaaugaacagggccuua

SEQ ID NO: 5480 - RNA, 21 nt, Artificial Sequence
  Synthetic construct
uuagaguacccugggucuggg

SEQ ID NO: 5481 - RNA, 21 nt, Artificial Sequence
  Synthetic construct
uggagcuugggcuagcugggg

SEQ ID NO: 5482 - RNA, 21 nt, Artificial Sequence
  Synthetic construct
uagaguacccugggucuggga

SEQ ID NO: 5483 - RNA, 21 nt, Artificial Sequence
  Synthetic construct
uggacuggacggauucuugug

SEQ ID NO: 5484 - RNA, 21 nt, Artificial Sequence
  Synthetic construct
uugaaggcuaccucggacucc

SEQ ID NO: 5485 - RNA, 21 nt, Artificial Sequence
  Synthetic construct
ucugcaaugacucugagcagg

SEQ ID NO: 5486 - RNA, 21 nt, Artificial Sequence
  Synthetic construct
ucaaggguccugucagcucua

SEQ ID NO: 5487 - RNA, 21 nt, Artificial Sequence
  Synthetic construct
uaagcauagggauucauuuug

SEQ ID NO: 5488 - RNA, 21 nt, Artificial Sequence
  Synthetic construct
uugccuaagaaggcuaaguga

SEQ ID NO: 5489 - RNA, 21 nt, Artificial Sequence
  Synthetic construct
uuuccuuccuucuguuccuuu

SEQ ID NO: 5490 - RNA, 21 nt, Artificial Sequence
  Synthetic construct
ugagcgguagucucagugccu

SEQ ID NO: 5491 - RNA, 21 nt, Artificial Sequence
  Synthetic construct
cuuaacuagagucucuccuug

SEQ ID NO: 5492 - RNA, 21 nt, Artificial Sequence
  Synthetic construct
uuuacacagaacaaucuuuac

SEQ ID NO: 5493 - RNA, 21 nt, Artificial Sequence
  Synthetic construct
uagucucagugccugagccgc

SEQ ID NO: 5494 - RNA, 21 nt, Artificial Sequence
  Synthetic construct
ucuauggaggagacauaaccg

SEQ ID NO: 5495 - RNA, 21 nt, Artificial Sequence
  Synthetic construct
uucaaggguccugucagcucu

SEQ ID NO: 5496 - RNA, 21 nt, Artificial Sequence
  Synthetic construct
uauggaggagacauaaccgcc

SEQ ID NO: 5497 - RNA, 21 nt, Artificial Sequence
  Synthetic construct
ugugaccuggucauuaagcau

SEQ ID NO: 5498 - RNA, 21 nt, Artificial Sequence
  Synthetic construct
uucugcagccuccucucccgc

SEQ ID NO: 5499 - RNA, 21 nt, Artificial Sequence
  Synthetic construct
uuucuuuccuuccuucuguuc

SEQ ID NO: 5500 - RNA, 21 nt, Artificial Sequence
  Synthetic construct
uaagggcgaacugucagcuuu

SEQ ID NO: 5501 - RNA, 21 nt, Artificial Sequence
  Synthetic construct
ugagagaacgggaaucaucca

SEQ ID NO: 5502 - RNA, 21 nt, Artificial Sequence
  Synthetic construct
augcaggcacuuaccucccug

SEQ ID NO: 5503 - RNA, 21 nt, Artificial Sequence
  Synthetic construct
ugacccucugggcugcaccag

SEQ ID NO: 5504 - RNA, 21 nt, Artificial Sequence
  Synthetic construct
ucauucaucaagcaacucuac

SEQ ID NO: 5505 - RNA, 21 nt, Artificial Sequence
  Synthetic construct
uaacuguuuauuauaaagaca

SEQ ID NO: 5506 - RNA, 21 nt, Artificial Sequence
  Synthetic construct
auucaucaagcaacucuacuu

SEQ ID NO: 5507 - RNA, 21 nt, Artificial Sequence
  Synthetic construct
uuccuucuguuccuuugcuuu

SEQ ID NO: 5508 - RNA, 21 nt, Artificial Sequence
  Synthetic construct
aucaaauguauuuauugcuga

SEQ ID NO: 5509 - RNA, 21 nt, Artificial Sequence
  Synthetic construct
uagaaccgauuugggaugcag

SEQ ID NO: 5510 - RNA, 21 nt, Artificial Sequence
  Synthetic construct
aaguaggagaugggagaccug

SEQ ID NO: 5511 - RNA, 21 nt, Artificial Sequence
  Synthetic construct
uaagaaucauaaacaaccacu

SEQ ID NO: 5512 - RNA, 21 nt, Artificial Sequence
  Synthetic construct
uagcccacccacuacccucuu

SEQ ID NO: 5513 - RNA, 21 nt, Artificial Sequence
  Synthetic construct
aucaggcucuugucuucucuu

SEQ ID NO: 5514 - RNA, 21 nt, Artificial Sequence
  Synthetic construct
uuuccuccgaccucccugcca

SEQ ID NO: 5515 - RNA, 21 nt, Artificial Sequence
  Synthetic construct
uugggcaucaggcucuugucu

SEQ ID NO: 5516 - RNA, 21 nt, Artificial Sequence
  Synthetic construct
aacaaucuuuacaaacauuga

SEQ ID NO: 5517 - RNA, 21 nt, Artificial Sequence
  Synthetic construct
ucuuuacaaacauugaacaca

SEQ ID NO: 5518 - RNA, 21 nt, Artificial Sequence
  Synthetic construct
ugucuucucuuucucccuccu

SEQ ID NO: 5519 - RNA, 21 nt, Artificial Sequence
  Synthetic construct
ucauuaagcauagggauucau

SEQ ID NO: 5520 - RNA, 21 nt, Artificial Sequence
  Synthetic construct
uuaaucaguauguucuuaaau

SEQ ID NO: 5521 - RNA, 21 nt, Artificial Sequence
  Synthetic construct
uaccucucccuuaacugagca

SEQ ID NO: 5522 - RNA, 21 nt, Artificial Sequence
  Synthetic construct
auuucuuaaugaacagggccu

SEQ ID NO: 5523 - RNA, 21 nt, Artificial Sequence
  Synthetic construct
ucccuuaacugagcaaacgcu

SEQ ID NO: 5524 - RNA, 21 nt, Artificial Sequence
  Synthetic construct
uuaagcagcagcagcagcagc

SEQ ID NO: 5525 - RNA, 21 nt, Artificial Sequence
  Synthetic construct
uuauaaagacauauuuacaca

SEQ ID NO: 5526 - RNA, 21 nt, Artificial Sequence
  Synthetic construct
ucuuuguauaaauuaguauaa

SEQ ID NO: 5527 - RNA, 21 nt, Artificial Sequence
  Synthetic construct
uugggaugcaggcacuuaccu

SEQ ID NO: 5528 - RNA, 21 nt, Artificial Sequence
  Synthetic construct
ugagcaaacgcugaugcucca

SEQ ID NO: 5529 - RNA, 21 nt, Artificial Sequence
  Synthetic construct
uagagucucuccuugcuuuuc

SEQ ID NO: 5530 - RNA, 21 nt, Artificial Sequence
  Synthetic construct
aagcagcagcagcagcagcag

SEQ ID NO: 5531 - RNA, 21 nt, Artificial Sequence
  Synthetic construct
agugacaaaggacuucacggg

SEQ ID NO: 5532 - RNA, 21 nt, Artificial Sequence
  Synthetic construct
aagagaagugacaaaggacuu

SEQ ID NO: 5533 - RNA, 21 nt, Artificial Sequence
  Synthetic construct
uucaugcugcuccuugggccg

SEQ ID NO: 5534 - RNA, 21 nt, Artificial Sequence
  Synthetic construct
ugcugcacuuccucccaucuu

SEQ ID NO: 5535 - RNA, 21 nt, Artificial Sequence
  Synthetic construct
ucucauucaucaagcaacucu

SEQ ID NO: 5536 - RNA, 21 nt, Artificial Sequence
  Synthetic construct
aucucauucaucaagcaacuc

SEQ ID NO: 5537 - RNA, 21 nt, Artificial Sequence
  Synthetic construct
aauuucuuaaugaacagggcc

SEQ ID NO: 5538 - RNA, 21 nt, Artificial Sequence
  Synthetic construct
aguauguucuuaaauaaacug

SEQ ID NO: 5539 - RNA, 21 nt, Artificial Sequence
  Synthetic construct
uaagcagcagcagcagcagca

SEQ ID NO: 5540 - RNA, 21 nt, Artificial Sequence
  Synthetic construct
agacauauuuacacagaacaa

SEQ ID NO: 5541 - RNA, 21 nt, Artificial Sequence
  Synthetic construct
uuagaugagacaggcagggac

SEQ ID NO: 5542 - RNA, 21 nt, Artificial Sequence
  Synthetic construct
ugaacagggccuuaauaucuu

SEQ ID NO: 5543 - RNA, 21 nt, Artificial Sequence
  Synthetic construct
auaaagacauauuuacacaga

SEQ ID NO: 5544 - RNA, 21 nt, Artificial Sequence
  Synthetic construct
acacagaacaaucuuuacaaa

SEQ ID NO: 5545 - RNA, 21 nt, Artificial Sequence
  Synthetic construct
uaggacacccaaacagaugcc

SEQ ID NO: 5546 - RNA, 21 nt, Artificial Sequence
  Synthetic construct
uccucccaucuuucuuuccuu

SEQ ID NO: 5547 - RNA, 21 nt, Artificial Sequence
  Synthetic construct
uaggagaugggagaccugguc

SEQ ID NO: 5548 - RNA, 21 nt, Artificial Sequence
  Synthetic construct
ugaacaugaccuccaagagua

SEQ ID NO: 5549 - RNA, 21 nt, Artificial Sequence
  Synthetic construct
ugcaaugacucugagcagguc

SEQ ID NO: 5550 - RNA, 21 nt, Artificial Sequence
  Synthetic construct
ucuccaaagucaguccaggga

SEQ ID NO: 5551 - RNA, 21 nt, Artificial Sequence
  Synthetic construct
agcagcagcagcagcagcguu

SEQ ID NO: 5552 - RNA, 21 nt, Artificial Sequence
  Synthetic construct
uucagaaaggcaugggucccu

SEQ ID NO: 5553 - RNA, 21 nt, Artificial Sequence
  Synthetic construct
ucuuuccuuccuucuguuccu

SEQ ID NO: 5554 - RNA, 21 nt, Artificial Sequence
  Synthetic construct
agugauugaaggcuaccucgg

SEQ ID NO: 5555 - RNA, 21 nt, Artificial Sequence
  Synthetic construct
auuccuugacccucugggcug

SEQ ID NO: 5556 - RNA, 21 nt, Artificial Sequence
  Synthetic construct
uaaggcaagagaagugacaaa

SEQ ID NO: 5557 - RNA, 21 nt, Artificial Sequence
  Synthetic construct
uucccuccuuccuucugcccu

SEQ ID NO: 5558 - RNA, 21 nt, Artificial Sequence
  Synthetic construct
uggaaccuuccagcccagcug

SEQ ID NO: 5559 - RNA, 21 nt, Artificial Sequence
  Synthetic construct
agaacaaucuuuacaaacauu

SEQ ID NO: 5560 - RNA, 21 nt, Artificial Sequence
  Synthetic construct
ucuucucuuucucccuccugg

SEQ ID NO: 5561 - RNA, 21 nt, Artificial Sequence
  Synthetic construct
uuccuuccuucuguuccuuug

SEQ ID NO: 5562 - RNA, 21 nt, Artificial Sequence
  Synthetic construct
uuauuauaaagacauauuuac

SEQ ID NO: 5563 - RNA, 21 nt, Artificial Sequence
  Synthetic construct
ucuacuuugugaaacauaaaa

SEQ ID NO: 5564 - RNA, 21 nt, Artificial Sequence
  Synthetic construct
ugcacgugcaauaugugggca

SEQ ID NO: 5565 - RNA, 21 nt, Artificial Sequence
  Synthetic construct
uuccucccaucuuucuuuccu

SEQ ID NO: 5566 - RNA, 21 nt, Artificial Sequence
  Synthetic construct
aacucuacuuugugaaacaua

SEQ ID NO: 5567 - RNA, 21 nt, Artificial Sequence
  Synthetic construct
uucuugugagagaacgggaau

SEQ ID NO: 5568 - RNA, 21 nt, Artificial Sequence
  Synthetic construct
ucucugcauucuucccuggag

SEQ ID NO: 5569 - RNA, 21 nt, Artificial Sequence
  Synthetic construct
acaauuucuuaaugaacaggg

SEQ ID NO: 5570 - RNA, 21 nt, Artificial Sequence
  Synthetic construct
auaaacaaccacuuuaaauaa

SEQ ID NO: 5571 - RNA, 21 nt, Artificial Sequence
  Synthetic construct
aggucuccaaagucaguccag

SEQ ID NO: 5572 - RNA, 21 nt, Artificial Sequence
  Synthetic construct
agaagcagaccaaucuaugga

SEQ ID NO: 5573 - RNA, 21 nt, Artificial Sequence
  Synthetic construct
aacaaagucauuaucaaaugu

SEQ ID NO: 5574 - RNA, 21 nt, Artificial Sequence
  Synthetic construct
augcuccacccacuucaccag

SEQ ID NO: 5575 - RNA, 21 nt, Artificial Sequence
  Synthetic construct
aaucauaaacaaccacuuuaa

SEQ ID NO: 5576 - RNA, 21 nt, Artificial Sequence
  Synthetic construct
ugauugaaggcuaccucggac

SEQ ID NO: 5577 - RNA, 21 nt, Artificial Sequence
  Synthetic construct
uaagaaggcuaagugaccuuc

SEQ ID NO: 5578 - RNA, 21 nt, Artificial Sequence
  Synthetic construct
cagaacaaucuuuacaaacau

SEQ ID NO: 5579 - RNA, 21 nt, Artificial Sequence
  Synthetic construct
aacugagcaaacgcugaugcu

SEQ ID NO: 5580 - RNA, 21 nt, Artificial Sequence
  Synthetic construct
cucuuaacuagagucucuccu

SEQ ID NO: 5581 - RNA, 21 nt, Artificial Sequence
  Synthetic construct
acaaccacuuuaaauaaggca

SEQ ID NO: 5582 - RNA, 21 nt, Artificial Sequence
  Synthetic construct
uauaaauuaguauaagaauca

SEQ ID NO: 5583 - RNA, 21 nt, Artificial Sequence
  Synthetic construct
uuucucccuccugggaacccu

SEQ ID NO: 5584 - RNA, 21 nt, Artificial Sequence
  Synthetic construct
ucucuuucucccuccugggaa

SEQ ID NO: 5585 - RNA, 21 nt, Artificial Sequence
  Synthetic construct
uuugccuaagaaggcuaagug

SEQ ID NO: 5586 - RNA, 21 nt, Artificial Sequence
  Synthetic construct
uauuccugcugcacuuccucc

SEQ ID NO: 5587 - RNA, 21 nt, Artificial Sequence
  Synthetic construct
acuagagucucuccuugcuuu

SEQ ID NO: 5588 - RNA, 21 nt, Artificial Sequence
  Synthetic construct
aagaagggaggcuuucugggg

SEQ ID NO: 5589 - RNA, 21 nt, Artificial Sequence
  Synthetic construct
auugggaggcacacuaaggca

SEQ ID NO: 5590 - RNA, 21 nt, Artificial Sequence
  Synthetic construct
uucucccuccugggaacccug

SEQ ID NO: 5591 - RNA, 21 nt, Artificial Sequence
  Synthetic construct
ugggucugggaaugcugccag

SEQ ID NO: 5592 - RNA, 21 nt, Artificial Sequence
  Synthetic construct
ucagggacccuccacacaccg

SEQ ID NO: 5593 - RNA, 21 nt, Artificial Sequence
  Synthetic construct
ugagugugcgcgcugagcccc

SEQ ID NO: 5594 - RNA, 21 nt, Artificial Sequence
  Synthetic construct
aagugacaaaggacuucacgg

SEQ ID NO: 5595 - RNA, 21 nt, Artificial Sequence
  Synthetic construct
aauaucuuuguauaaauuagu

SEQ ID NO: 5596 - RNA, 21 nt, Artificial Sequence
  Synthetic construct
cucugcaaugacucugagcag

SEQ ID NO: 5597 - RNA, 21 nt, Artificial Sequence
  Synthetic construct
cuuuccuuccuucuguuccuu

SEQ ID NO: 5598 - RNA, 21 nt, Artificial Sequence
  Synthetic construct
agauucaugcugcuccuuggg

SEQ ID NO: 5599 - RNA, 21 nt, Artificial Sequence
  Synthetic construct
caacaggacaguucacagcca

SEQ ID NO: 5600 - RNA, 21 nt, Artificial Sequence
  Synthetic construct
uuagcagcagcauagguaaag

SEQ ID NO: 5601 - RNA, 21 nt, Artificial Sequence
  Synthetic construct
aacuguuuauuauaaagacau

SEQ ID NO: 5602 - RNA, 21 nt, Artificial Sequence
  Synthetic construct
aagugaccuucaaggguccug

SEQ ID NO: 5603 - RNA, 21 nt, Artificial Sequence
  Synthetic construct
uuccuccgaccucccugccag

SEQ ID NO: 5604 - RNA, 21 nt, Artificial Sequence
  Synthetic construct
gucuucucuuucucccuccug

SEQ ID NO: 5605 - RNA, 21 nt, Artificial Sequence
  Synthetic construct
cuuaacugagcaaacgcugau

SEQ ID NO: 5606 - RNA, 21 nt, Artificial Sequence
  Synthetic construct
uauuauaaagacauauuuaca

SEQ ID NO: 5607 - RNA, 21 nt, Artificial Sequence
  Synthetic construct
auucccaucgggaagcggcau

SEQ ID NO: 5608 - RNA, 21 nt, Artificial Sequence
  Synthetic construct
aucauaaacaaccacuuuaaa

SEQ ID NO: 5609 - RNA, 21 nt, Artificial Sequence
  Synthetic construct
uauugggaggcacacuaaggc

SEQ ID NO: 5610 - RNA, 21 nt, Artificial Sequence
  Synthetic construct
aaggcuaccucggacuccuga

SEQ ID NO: 5611 - RNA, 21 nt, Artificial Sequence
  Synthetic construct
gugauugaaggcuaccucgga

SEQ ID NO: 5612 - RNA, 21 nt, Artificial Sequence
  Synthetic construct
ucccaucuuucuuuccuuccu

SEQ ID NO: 5613 - RNA, 21 nt, Artificial Sequence
  Synthetic construct
ucauaaaguaggagaugggag

SEQ ID NO: 5614 - RNA, 21 nt, Artificial Sequence
  Synthetic construct
acaaagucauuaucaaaugua

SEQ ID NO: 5615 - RNA, 21 nt, Artificial Sequence
  Synthetic construct
ugaccuucaaggguccuguca

SEQ ID NO: 5616 - RNA, 21 nt, Artificial Sequence
  Synthetic construct
aaaguugggcaucaggcucuu

SEQ ID NO: 5617 - RNA, 21 nt, Artificial Sequence
  Synthetic construct
acucugagcaggucacucccc

SEQ ID NO: 5618 - RNA, 21 nt, Artificial Sequence
  Synthetic construct
aucuuuguauaaauuaguaua

SEQ ID NO: 5619 - RNA, 21 nt, Artificial Sequence
  Synthetic construct
ugauacaaacaaagucauuau

SEQ ID NO: 5620 - RNA, 21 nt, Artificial Sequence
  Synthetic construct
cuuccuucuguuccuuugcuu

SEQ ID NO: 5621 - RNA, 21 nt, Artificial Sequence
  Synthetic construct
uccugggaggguauauagcca

SEQ ID NO: 5622 - RNA, 21 nt, Artificial Sequence
  Synthetic construct
caacucuacuuugugaaacau

SEQ ID NO: 5623 - RNA, 21 nt, Artificial Sequence
  Synthetic construct
uuuguauaaauuaguauaaga

SEQ ID NO: 5624 - RNA, 21 nt, Artificial Sequence
  Synthetic construct
cuugucuucucuuucucccuc

SEQ ID NO: 5625 - RNA, 21 nt, Artificial Sequence
  Synthetic construct
ugggaugcaggcacuuaccuc

SEQ ID NO: 5626 - RNA, 21 nt, Artificial Sequence
  Synthetic construct
ucuucugcagccuccucuccc

SEQ ID NO: 5627 - RNA, 21 nt, Artificial Sequence
  Synthetic construct
augaccuccaagaguaagggc

SEQ ID NO: 5628 - RNA, 21 nt, Artificial Sequence
  Synthetic construct
aauuaguauaagaaucauaaa

SEQ ID NO: 5629 - RNA, 21 nt, Artificial Sequence
  Synthetic construct
ugggcaucaggcucuugucuu

SEQ ID NO: 5630 - RNA, 21 nt, Artificial Sequence
  Synthetic construct
ucucuaccucucccuuaacug

SEQ ID NO: 5631 - RNA, 21 nt, Artificial Sequence
  Synthetic construct
auuauaaagacauauuuacac

SEQ ID NO: 5632 - RNA, 21 nt, Artificial Sequence
  Synthetic construct
uaacugagcaaacgcugaugc

SEQ ID NO: 5633 - RNA, 21 nt, Artificial Sequence
  Synthetic construct
ucaucaagagggaagagggcg

SEQ ID NO: 5634 - RNA, 21 nt, Artificial Sequence
  Synthetic construct
ucuguuccuuugcuuucuuuu

SEQ ID NO: 5635 - RNA, 21 nt, Artificial Sequence
  Synthetic construct
aucucccagcuuucuuagcca

SEQ ID NO: 5636 - RNA, 21 nt, Artificial Sequence
  Synthetic construct
ugcuggagcccacagaaggga

SEQ ID NO: 5637 - RNA, 21 nt, Artificial Sequence
  Synthetic construct
uucugggcaccgaccaguccc

SEQ ID NO: 5638 - RNA, 21 nt, Artificial Sequence
  Synthetic construct
uggauaggcaaacauuggggc

SEQ ID NO: 5639 - RNA, 21 nt, Artificial Sequence
  Synthetic construct
uccgcucuucugcagccuccu

SEQ ID NO: 5640 - RNA, 21 nt, Artificial Sequence
  Synthetic construct
ugaccuccaagaguaagggcg

SEQ ID NO: 5641 - RNA, 21 nt, Artificial Sequence
  Synthetic construct
uaggucagggaggugggagca

SEQ ID NO: 5642 - RNA, 21 nt, Artificial Sequence
  Synthetic construct
aaguugggcaucaggcucuug

SEQ ID NO: 5643 - RNA, 21 nt, Artificial Sequence
  Synthetic construct
auuaggacacccaaacagaug

SEQ ID NO: 5644 - RNA, 21 nt, Artificial Sequence
  Synthetic construct
uuuaaucaguauguucuuaaa

SEQ ID NO: 5645 - RNA, 21 nt, Artificial Sequence
  Synthetic construct
uuaaugaacagggccuuaaua

SEQ ID NO: 5646 - RNA, 21 nt, Artificial Sequence
  Synthetic construct
gucagcucuaacauucuguga

SEQ ID NO: 5647 - RNA, 21 nt, Artificial Sequence
  Synthetic construct
ccugucagcucuaacauucug

SEQ ID NO: 5648 - RNA, 21 nt, Artificial Sequence
  Synthetic construct
accucuuaacuagagucucuc

SEQ ID NO: 5649 - RNA, 21 nt, Artificial Sequence
  Synthetic construct
ucaacacgaagggaaggccau

SEQ ID NO: 5650 - RNA, 21 nt, Artificial Sequence
  Synthetic construct
cuauggaggagacauaaccgc

SEQ ID NO: 5651 - RNA, 21 nt, Artificial Sequence
  Synthetic construct
uccaagaguaagggcgaacug

SEQ ID NO: 5652 - RNA, 21 nt, Artificial Sequence
  Synthetic construct
cuucuguucccuaucucccag

SEQ ID NO: 5653 - RNA, 21 nt, Artificial Sequence
  Synthetic construct
aaugacucugagcaggucacu

SEQ ID NO: 5654 - RNA, 21 nt, Artificial Sequence
  Synthetic construct
acaaacaaagucauuaucaaa

SEQ ID NO: 5655 - RNA, 21 nt, Artificial Sequence
  Synthetic construct
auuccugcugcacuuccuccc

SEQ ID NO: 5656 - RNA, 21 nt, Artificial Sequence
  Synthetic construct
accgcggucaaggagagccag

SEQ ID NO: 5657 - RNA, 21 nt, Artificial Sequence
  Synthetic construct
gaaucauccaaacuacagcca

SEQ ID NO: 5658 - RNA, 21 nt, Artificial Sequence
  Synthetic construct
uacagcaggugcgaggugaga

SEQ ID NO: 5659 - RNA, 21 nt, Artificial Sequence
  Synthetic construct
aggaagguccggucaacacga

SEQ ID NO: 5660 - RNA, 21 nt, Artificial Sequence
  Synthetic construct
augauacaaacaaagucauua

SEQ ID NO: 5661 - RNA, 21 nt, Artificial Sequence
  Synthetic construct
cuuuacaaacauugaacacag

SEQ ID NO: 5662 - RNA, 21 nt, Artificial Sequence
  Synthetic construct
ucaugcugcuccuugggccgc

SEQ ID NO: 5663 - RNA, 21 nt, Artificial Sequence
  Synthetic construct
agcccuggaaggaagguccgg

SEQ ID NO: 5664 - RNA, 21 nt, Artificial Sequence
  Synthetic construct
ugagagcugaauggacgugag

SEQ ID NO: 5665 - RNA, 21 nt, Artificial Sequence
  Synthetic construct
uuaaauaaacugcuuuaaaaa

SEQ ID NO: 5666 - RNA, 21 nt, Artificial Sequence
  Synthetic construct
acauugccgucuuccagccca

SEQ ID NO: 5667 - RNA, 21 nt, Artificial Sequence
  Synthetic construct
aaucuuuacaaacauugaaca

SEQ ID NO: 5668 - RNA, 21 nt, Artificial Sequence
  Synthetic construct
augacucugagcaggucacuc

SEQ ID NO: 5669 - RNA, 21 nt, Artificial Sequence
  Synthetic construct
auuagaguacccugggucugg

SEQ ID NO: 5670 - RNA, 21 nt, Artificial Sequence
  Synthetic construct
aaacgcugaugcuccacccac

SEQ ID NO: 5671 - RNA, 21 nt, Artificial Sequence
  Synthetic construct
aagcagaccaaucuauggagg

SEQ ID NO: 5672 - RNA, 21 nt, Artificial Sequence
  Synthetic construct
uccuuccuucugcccuucccu

SEQ ID NO: 5673 - RNA, 21 nt, Artificial Sequence
  Synthetic construct
cuuucuuuccuuccuucuguu

SEQ ID NO: 5674 - RNA, 21 nt, Artificial Sequence
  Synthetic construct
uugacccucugggcugcacca

SEQ ID NO: 5675 - RNA, 21 nt, Artificial Sequence
  Synthetic construct
uuccuugacccucugggcugc

SEQ ID NO: 5676 - RNA, 21 nt, Artificial Sequence
  Synthetic construct
aacagggccuuaauaucuuug

SEQ ID NO: 5677 - RNA, 21 nt, Artificial Sequence
  Synthetic construct
uucccuaucucccagcuuucu

SEQ ID NO: 5678 - RNA, 21 nt, Artificial Sequence
  Synthetic construct
aucaucaagagggaagagggc

SEQ ID NO: 5679 - RNA, 21 nt, Artificial Sequence
  Synthetic construct
aucgggaagcggcaucaggga

SEQ ID NO: 5680 - RNA, 21 nt, Artificial Sequence
  Synthetic construct
ugaauggacgugaggccucca

SEQ ID NO: 5681 - RNA, 21 nt, Artificial Sequence
  Synthetic construct
cauuuaaucaguauguucuua

SEQ ID NO: 5682 - RNA, 21 nt, Artificial Sequence
  Synthetic construct
aagagacuuucugggcaccga

SEQ ID NO: 5683 - RNA, 21 nt, Artificial Sequence
  Synthetic construct
ugagacaggcagggacuaggg

SEQ ID NO: 5684 - RNA, 21 nt, Artificial Sequence
  Synthetic construct
auggacuggacggauucuugu

SEQ ID NO: 5685 - RNA, 21 nt, Artificial Sequence
  Synthetic construct
agaaggcuaagugaccuucaa

SEQ ID NO: 5686 - RNA, 21 nt, Artificial Sequence
  Synthetic construct
aaagucauuaucaaauguauu

SEQ ID NO: 5687 - RNA, 21 nt, Artificial Sequence
  Synthetic construct
ugaccuggucauuaagcauag

SEQ ID NO: 5688 - RNA, 21 nt, Artificial Sequence
  Synthetic construct
agcguuagcagcagcauaggu

SEQ ID NO: 5689 - RNA, 21 nt, Artificial Sequence
  Synthetic construct
uaguagcgauccugcauuuaa

SEQ ID NO: 5690 - RNA, 21 nt, Artificial Sequence
  Synthetic construct
gaacaauuucuuaaugaacag

SEQ ID NO: 5691 - RNA, 21 nt, Artificial Sequence
  Synthetic construct
aacaugaccuccaagaguaag

SEQ ID NO: 5692 - RNA, 21 nt, Artificial Sequence
  Synthetic construct
ugaaggcuaccucggacuccu

SEQ ID NO: 5693 - RNA, 21 nt, Artificial Sequence
  Synthetic construct
cugucagcucuaacauucugu

SEQ ID NO: 5694 - RNA, 21 nt, Artificial Sequence
  Synthetic construct
uguauaaauuaguauaagaau

SEQ ID NO: 5695 - RNA, 21 nt, Artificial Sequence
  Synthetic construct
acacacaaaguugggcaucag

SEQ ID NO: 5696 - RNA, 21 nt, Artificial Sequence
  Synthetic construct
gagagaacgggaaucauccaa

SEQ ID NO: 5697 - RNA, 21 nt, Artificial Sequence
  Synthetic construct
uccagugauugaaggcuaccu

SEQ ID NO: 5698 - RNA, 21 nt, Artificial Sequence
  Synthetic construct
uaucucauucaucaagcaacu

SEQ ID NO: 5699 - RNA, 21 nt, Artificial Sequence
  Synthetic construct
agaguaagggcgaacugucag

SEQ ID NO: 5700 - RNA, 21 nt, Artificial Sequence
  Synthetic construct
ucccuccuuccuucugcccuu

SEQ ID NO: 5701 - RNA, 21 nt, Artificial Sequence
  Synthetic construct
uccugcuucagaaaggcaugg

SEQ ID NO: 5702 - RNA, 21 nt, Artificial Sequence
  Synthetic construct
uuucugggcaccgaccagucc

SEQ ID NO: 5703 - RNA, 21 nt, Artificial Sequence
  Synthetic construct
aggcacuucauuugcuuugaa

SEQ ID NO: 5704 - RNA, 21 nt, Artificial Sequence
  Synthetic construct
ucugcccuucccuuccuucuu

SEQ ID NO: 5705 - RNA, 21 nt, Artificial Sequence
  Synthetic construct
cuaacauucugugauucuugg

SEQ ID NO: 5706 - RNA, 21 nt, Artificial Sequence
  Synthetic construct
uaucucccagcuuucuuagcc

SEQ ID NO: 5707 - RNA, 21 nt, Artificial Sequence
  Synthetic construct
caagcaacucuacuuugugaa

SEQ ID NO: 5708 - RNA, 21 nt, Artificial Sequence
  Synthetic construct
aaccgauuugggaugcaggca

SEQ ID NO: 5709 - RNA, 21 nt, Artificial Sequence
  Synthetic construct
auacaaacaaagucauuauca

SEQ ID NO: 5710 - RNA, 21 nt, Artificial Sequence
  Synthetic construct
uccuucugcccuucccuuccu

SEQ ID NO: 5711 - RNA, 21 nt, Artificial Sequence
  Synthetic construct
acaugaggaaggaaggcccaa

SEQ ID NO: 5712 - RNA, 21 nt, Artificial Sequence
  Synthetic construct
gaagggagcacuuccaccccg

SEQ ID NO: 5713 - RNA, 21 nt, Artificial Sequence
  Synthetic construct
guagucucagugccugagccg

SEQ ID NO: 5714 - RNA, 21 nt, Artificial Sequence
  Synthetic construct
uccugucagcucuaacauucu

SEQ ID NO: 5715 - RNA, 21 nt, Artificial Sequence
  Synthetic construct
ucccuaucucccagcuuucuu

SEQ ID NO: 5716 - RNA, 21 nt, Artificial Sequence
  Synthetic construct
cuaagaaggcuaagugaccuu

SEQ ID NO: 5717 - RNA, 21 nt, Artificial Sequence
  Synthetic construct
aggacacccaaacagaugcca

SEQ ID NO: 5718 - RNA, 21 nt, Artificial Sequence
  Synthetic construct
aaucaguauguucuuaaauaa

SEQ ID NO: 5719 - RNA, 21 nt, Artificial Sequence
  Synthetic construct
aguugaccuagaaccgauuug

SEQ ID NO: 5720 - RNA, 21 nt, Artificial Sequence
  Synthetic construct
caaacgcugaugcuccaccca

SEQ ID NO: 5721 - RNA, 21 nt, Artificial Sequence
  Synthetic construct
agcagcagcauagguaaaggg

SEQ ID NO: 5722 - RNA, 21 nt, Artificial Sequence
  Synthetic construct
aaccuuccagcccagcugggg

SEQ ID NO: 5723 - RNA, 21 nt, Artificial Sequence
  Synthetic construct
cuggucauuaagcauagggau

SEQ ID NO: 5724 - RNA, 21 nt, Artificial Sequence
  Synthetic construct
ucauaaacaaccacuuuaaau

SEQ ID NO: 5725 - RNA, 21 nt, Artificial Sequence
  Synthetic construct
agagaagugacaaaggacuuc

SEQ ID NO: 5726 - RNA, 21 nt, Artificial Sequence
  Synthetic construct
cagagccgcagauucaugcug

SEQ ID NO: 5727 - RNA, 21 nt, Artificial Sequence
  Synthetic construct
aagggaacaauuucuuaauga

SEQ ID NO: 5728 - RNA, 21 nt, Artificial Sequence
  Synthetic construct
cuagagucucuccuugcuuuu

SEQ ID NO: 5729 - RNA, 21 nt, Artificial Sequence
  Synthetic construct
ucagaaaggcaugggucccuu

SEQ ID NO: 5730 - RNA, 21 nt, Artificial Sequence
  Synthetic construct
uagcgauccugcauuuaauca

SEQ ID NO: 5731 - RNA, 21 nt, Artificial Sequence
  Synthetic construct
uucuguucccuaucucccagc

SEQ ID NO: 5732 - RNA, 21 nt, Artificial Sequence
  Synthetic construct
uggaguccagugauugaaggc

SEQ ID NO: 5733 - RNA, 21 nt, Artificial Sequence
  Synthetic construct
agucauuaucaaauguauuua

SEQ ID NO: 5734 - RNA, 21 nt, Artificial Sequence
  Synthetic construct
gaaucauaaacaaccacuuua

SEQ ID NO: 5735 - RNA, 21 nt, Artificial Sequence
  Synthetic construct
agguccggucaacacgaaggg

SEQ ID NO: 5736 - RNA, 21 nt, Artificial Sequence
  Synthetic construct
aguuauggaaccuuccagccc

SEQ ID NO: 5737 - RNA, 21 nt, Artificial Sequence
  Synthetic construct
gagagggugcuauuccugcug

SEQ ID NO: 5738 - RNA, 21 nt, Artificial Sequence
  Synthetic construct
aggaagaagggaguauuggga

SEQ ID NO: 5739 - RNA, 21 nt, Artificial Sequence
  Synthetic construct
cucuaacauucugugauucuu

SEQ ID NO: 5740 - RNA, 21 nt, Artificial Sequence
  Synthetic construct
agaagugacaaaggacuucac

SEQ ID NO: 5741 - RNA, 21 nt, Artificial Sequence
  Synthetic construct
ucagggaggugggagcagcuc

SEQ ID NO: 5742 - RNA, 21 nt, Artificial Sequence
  Synthetic construct
aggagacacagaaaggaaggg

SEQ ID NO: 5743 - RNA, 21 nt, Artificial Sequence
  Synthetic construct
ugcacuuccucccaucuuucu

SEQ ID NO: 5744 - RNA, 21 nt, Artificial Sequence
  Synthetic construct
auugaaggcuaccucggacuc

SEQ ID NO: 5745 - RNA, 21 nt, Artificial Sequence
  Synthetic construct
agaagggagcacuuccacccc

SEQ ID NO: 5746 - RNA, 21 nt, Artificial Sequence
  Synthetic construct
ucccuuaugggagaggcgggg

SEQ ID NO: 5747 - RNA, 21 nt, Artificial Sequence
  Synthetic construct
ugacaaaggacuucacgggcc

SEQ ID NO: 5748 - RNA, 21 nt, Artificial Sequence
  Synthetic construct
ugcaauaugugggcaugggga

SEQ ID NO: 5749 - RNA, 21 nt, Artificial Sequence
  Synthetic construct
acaggcagggacuagggcgga

SEQ ID NO: 5750 - RNA, 21 nt, Artificial Sequence
  Synthetic construct
acugagcaaacgcugaugcuc

SEQ ID NO: 5751 - RNA, 21 nt, Artificial Sequence
  Synthetic construct
ugcgaggugagagcugaaugg

SEQ ID NO: 5752 - RNA, 21 nt, Artificial Sequence
  Synthetic construct
accucucccuuaacugagcaa

SEQ ID NO: 5753 - RNA, 21 nt, Artificial Sequence
  Synthetic construct
ugcuccacccacuucaccaga

SEQ ID NO: 5754 - RNA, 21 nt, Artificial Sequence
  Synthetic construct
cuucuguuccuuugcuuucuu

SEQ ID NO: 5755 - RNA, 21 nt, Artificial Sequence
  Synthetic construct
ucauuaucaaauguauuuauu

SEQ ID NO: 5756 - RNA, 21 nt, Artificial Sequence
  Synthetic construct
ugacucugagcaggucacucc

SEQ ID NO: 5757 - RNA, 21 nt, Artificial Sequence
  Synthetic construct
aaggaagguccggucaacacg

SEQ ID NO: 5758 - RNA, 21 nt, Artificial Sequence
  Synthetic construct
aguaggagaugggagaccugg

SEQ ID NO: 5759 - RNA, 21 nt, Artificial Sequence
  Synthetic construct
uggucauuaagcauagggauu

SEQ ID NO: 5760 - RNA, 21 nt, Artificial Sequence
  Synthetic construct
gagcgguagucucagugccug

SEQ ID NO: 5761 - RNA, 21 nt, Artificial Sequence
  Synthetic construct
uaaugaacagggccuuaauau

SEQ ID NO: 5762 - RNA, 21 nt, Artificial Sequence
  Synthetic construct
ucccugcacgugcaauaugug

SEQ ID NO: 5763 - RNA, 21 nt, Artificial Sequence
  Synthetic construct
agcaccucuuaacuagagucu

SEQ ID NO: 5764 - RNA, 21 nt, Artificial Sequence
  Synthetic construct
acaaaguugggcaucaggcuc

SEQ ID NO: 5765 - RNA, 21 nt, Artificial Sequence
  Synthetic construct
cagagaagcagaccaaucuau

SEQ ID NO: 5766 - RNA, 21 nt, Artificial Sequence
  Synthetic construct
auggacgugaggccuccagag

SEQ ID NO: 5767 - RNA, 21 nt, Artificial Sequence
  Synthetic construct
aucaguauguucuuaaauaaa

SEQ ID NO: 5768 - RNA, 21 nt, Artificial Sequence
  Synthetic construct
agcgauccugcauuuaaucag

SEQ ID NO: 5769 - RNA, 21 nt, Artificial Sequence
  Synthetic construct
ugaggcaggagacacagaaag

SEQ ID NO: 5770 - RNA, 21 nt, Artificial Sequence
  Synthetic construct
aagaguaagggcgaacuguca

SEQ ID NO: 5771 - RNA, 21 nt, Artificial Sequence
  Synthetic construct
uugccucucccuucccuuccc

SEQ ID NO: 5772 - RNA, 21 nt, Artificial Sequence
  Synthetic construct
cuucucuuucucccuccuggg

SEQ ID NO: 5773 - RNA, 21 nt, Artificial Sequence
  Synthetic construct
cucauucaucaagcaacucua

SEQ ID NO: 5774 - RNA, 21 nt, Artificial Sequence
  Synthetic construct
aggcaggagacacagaaagga

SEQ ID NO: 5775 - RNA, 21 nt, Artificial Sequence
  Synthetic construct
uuaguauaagaaucauaaaca

SEQ ID NO: 5776 - RNA, 21 nt, Artificial Sequence
  Synthetic construct
uuaccucccugcacgugcaau

SEQ ID NO: 5777 - RNA, 21 nt, Artificial Sequence
  Synthetic construct
aagcaacucuacuuugugaaa

SEQ ID NO: 5778 - RNA, 21 nt, Artificial Sequence
  Synthetic construct
accuccaagaguaagggcgaa

SEQ ID NO: 5779 - RNA, 21 nt, Artificial Sequence
  Synthetic construct
uaaucaguauguucuuaaaua

SEQ ID NO: 5780 - RNA, 21 nt, Artificial Sequence
  Synthetic construct
aguccugcuucagaaaggcau

SEQ ID NO: 5781 - RNA, 21 nt, Artificial Sequence
  Synthetic construct
aggcaggugagaagagcuggg

SEQ ID NO: 5782 - RNA, 21 nt, Artificial Sequence
  Synthetic construct
guggauaggcaaacauugggg

SEQ ID NO: 5783 - RNA, 21 nt, Artificial Sequence
  Synthetic construct
ggauucuugugagagaacggg

SEQ ID NO: 5784 - RNA, 21 nt, Artificial Sequence
  Synthetic construct
ucucagugccugagccgcccc

SEQ ID NO: 5785 - RNA, 21 nt, Artificial Sequence
  Synthetic construct
acuguuuauuauaaagacaua

SEQ ID NO: 5786 - RNA, 21 nt, Artificial Sequence
  Synthetic construct
uccugcauuuaaucaguaugu

SEQ ID NO: 5787 - RNA, 21 nt, Artificial Sequence
  Synthetic construct
uucaguccugcuucagaaagg

SEQ ID NO: 5788 - RNA, 21 nt, Artificial Sequence
  Synthetic construct
auuuaaucaguauguucuuaa

SEQ ID NO: 5789 - RNA, 21 nt, Artificial Sequence
  Synthetic construct
auuaguauaagaaucauaaac

SEQ ID NO: 5790 - RNA, 21 nt, Artificial Sequence
  Synthetic construct
auaaaguaggagaugggagac

SEQ ID NO: 5791 - RNA, 21 nt, Artificial Sequence
  Synthetic construct
caagcaugagccuuuaagcag

SEQ ID NO: 5792 - RNA, 21 nt, Artificial Sequence
  Synthetic construct
gacauauuuacacagaacaau

SEQ ID NO: 5793 - RNA, 21 nt, Artificial Sequence
  Synthetic construct
uagaugagacaggcagggacu

SEQ ID NO: 5794 - RNA, 21 nt, Artificial Sequence
  Synthetic construct
uguucccuaucucccagcuuu

SEQ ID NO: 5795 - RNA, 21 nt, Artificial Sequence
  Synthetic construct
agcaggagcgccugcacgcag

SEQ ID NO: 5796 - RNA, 21 nt, Artificial Sequence
  Synthetic construct
uuaggacacccaaacagaugc

SEQ ID NO: 5797 - RNA, 21 nt, Artificial Sequence
  Synthetic construct
ucuuaaauaaacugcuuuaaa

SEQ ID NO: 5798 - RNA, 21 nt, Artificial Sequence
  Synthetic construct
uccuucuguuccuuugcuuuc

SEQ ID NO: 5799 - RNA, 21 nt, Artificial Sequence
  Synthetic construct
cccaucuuucuuuccuuccuu

SEQ ID NO: 5800 - RNA, 21 nt, Artificial Sequence
  Synthetic construct
aagucauuaucaaauguauuu

SEQ ID NO: 5801 - RNA, 21 nt, Artificial Sequence
  Synthetic construct
uucuuuccuuccuucuguucc

SEQ ID NO: 5802 - RNA, 21 nt, Artificial Sequence
  Synthetic construct
auggaguccagugauugaagg

SEQ ID NO: 5803 - RNA, 21 nt, Artificial Sequence
  Synthetic construct
acggaagcuagggccucccgg

SEQ ID NO: 5804 - RNA, 21 nt, Artificial Sequence
  Synthetic construct
uacccugggucugggaaugcu

SEQ ID NO: 5805 - RNA, 21 nt, Artificial Sequence
  Synthetic construct
acaagggaucugcuggagccc

SEQ ID NO: 5806 - RNA, 21 nt, Artificial Sequence
  Synthetic construct
agauggacuggacggauucuu

SEQ ID NO: 5807 - RNA, 21 nt, Artificial Sequence
  Synthetic construct
aucaagagggaagagggcguc

SEQ ID NO: 5808 - RNA, 21 nt, Artificial Sequence
  Synthetic construct
accuggagcuugggcuagcug

SEQ ID NO: 5809 - RNA, 21 nt, Artificial Sequence
  Synthetic construct
ucuuaaugaacagggccuuaa

SEQ ID NO: 5810 - RNA, 21 nt, Artificial Sequence
  Synthetic construct
gauucuugugagagaacggga

SEQ ID NO: 5811 - RNA, 21 nt, Artificial Sequence
  Synthetic construct
auugccgucuuccagcccauu

SEQ ID NO: 5812 - RNA, 21 nt, Artificial Sequence
  Synthetic construct
auuaucaaauguauuuauugc

SEQ ID NO: 5813 - RNA, 21 nt, Artificial Sequence
  Synthetic construct
agacaggcagggacuagggcg

SEQ ID NO: 5814 - RNA, 21 nt, Artificial Sequence
  Synthetic construct
ugcauuuaaucaguauguucu

SEQ ID NO: 5815 - RNA, 21 nt, Artificial Sequence
  Synthetic construct
cgcagauucaugcugcuccuu

SEQ ID NO: 5816 - RNA, 21 nt, Artificial Sequence
  Synthetic construct
auuaagcauagggauucauuu

SEQ ID NO: 5817 - RNA, 21 nt, Artificial Sequence
  Synthetic construct
auucaugcugcuccuugggcc

SEQ ID NO: 5818 - RNA, 21 nt, Artificial Sequence
  Synthetic construct
caccucuuaacuagagucucu

SEQ ID NO: 5819 - RNA, 21 nt, Artificial Sequence
  Synthetic construct
aacaaccacuuuaaauaaggc

SEQ ID NO: 5820 - RNA, 21 nt, Artificial Sequence
  Synthetic construct
uccaaagucaguccagggagg

SEQ ID NO: 5821 - RNA, 21 nt, Artificial Sequence
  Synthetic construct
agaugagacaggcagggacua

SEQ ID NO: 5822 - RNA, 21 nt, Artificial Sequence
  Synthetic construct
gcuaucucauucaucaagcaa

SEQ ID NO: 5823 - RNA, 21 nt, Artificial Sequence
  Synthetic construct
aacgggaaucauccaaacuac

SEQ ID NO: 5824 - RNA, 21 nt, Artificial Sequence
  Synthetic construct
acuacccucuucuguucccua

SEQ ID NO: 5825 - RNA, 21 nt, Artificial Sequence
  Synthetic construct
aagaaggcuaagugaccuuca

SEQ ID NO: 5826 - RNA, 21 nt, Artificial Sequence
  Synthetic construct
ucuguucccuaucucccagcu

SEQ ID NO: 5827 - RNA, 21 nt, Artificial Sequence
  Synthetic construct
aggugagagcugaauggacgu

SEQ ID NO: 5828 - RNA, 21 nt, Artificial Sequence
  Synthetic construct
agggacccuccacacaccgcg

SEQ ID NO: 5829 - RNA, 21 nt, Artificial Sequence
  Synthetic construct
cugaacaugaccuccaagagu

SEQ ID NO: 5830 - RNA, 21 nt, Artificial Sequence
  Synthetic construct
aguauugggaggcacacuaag

SEQ ID NO: 5831 - RNA, 21 nt, Artificial Sequence
  Synthetic construct
aggcucuugucuucucuuucu

SEQ ID NO: 5832 - RNA, 21 nt, Artificial Sequence
  Synthetic construct
ugcauucuucccuggaggcca

SEQ ID NO: 5833 - RNA, 21 nt, Artificial Sequence
  Synthetic construct
cacuucaccagagcuccugaa

SEQ ID NO: 5834 - RNA, 21 nt, Artificial Sequence
  Synthetic construct
caucaggcucuugucuucucu

SEQ ID NO: 5835 - RNA, 21 nt, Artificial Sequence
  Synthetic construct
guuauggaaccuuccagccca

SEQ ID NO: 5836 - RNA, 21 nt, Artificial Sequence
  Synthetic construct
cagcagcagcagcagcagcag

SEQ ID NO: 5837 - RNA, 21 nt, Artificial Sequence
  Synthetic construct
cuuaccucccugcacgugcaa

SEQ ID NO: 5838 - RNA, 21 nt, Artificial Sequence
  Synthetic construct
ggaggagacauaaccgccggg

SEQ ID NO: 5839 - RNA, 21 nt, Artificial Sequence
  Synthetic construct
guaagggcgaacugucagcuu

SEQ ID NO: 5840 - RNA, 21 nt, Artificial Sequence
  Synthetic construct
cugaccuggagcuugggcuag

SEQ ID NO: 5841 - RNA, 21 nt, Artificial Sequence
  Synthetic construct
agguggauaggcaaacauugg

SEQ ID NO: 5842 - RNA, 21 nt, Artificial Sequence
  Synthetic construct
cucuugucuucucuuucuccc

SEQ ID NO: 5843 - RNA, 21 nt, Artificial Sequence
  Synthetic construct
cauauuuacacagaacaaucu

SEQ ID NO: 5844 - RNA, 21 nt, Artificial Sequence
  Synthetic construct
aagggcgaacugucagcuuuu

SEQ ID NO: 5845 - RNA, 21 nt, Artificial Sequence
  Synthetic construct
agacuuucugggcaccgacca

SEQ ID NO: 5846 - RNA, 21 nt, Artificial Sequence
  Synthetic construct
aaacaaagucauuaucaaaug

SEQ ID NO: 5847 - RNA, 21 nt, Artificial Sequence
  Synthetic construct
acacuaaggcaagagaaguga

SEQ ID NO: 5848 - RNA, 21 nt, Artificial Sequence
  Synthetic construct
uccuugacccucugggcugca

SEQ ID NO: 5849 - RNA, 21 nt, Artificial Sequence
  Synthetic construct
caauuucuuaaugaacagggc

SEQ ID NO: 5850 - RNA, 21 nt, Artificial Sequence
  Synthetic construct
caucaagcaacucuacuuugu

SEQ ID NO: 5851 - RNA, 21 nt, Artificial Sequence
  Synthetic construct
agaagaagggaggcuuucugg

SEQ ID NO: 5852 - RNA, 21 nt, Artificial Sequence
  Synthetic construct
cagcagcagcagcagcagcgu

SEQ ID NO: 5853 - RNA, 21 nt, Artificial Sequence
  Synthetic construct
gaacaaucuuuacaaacauug

SEQ ID NO: 5854 - RNA, 21 nt, Artificial Sequence
  Synthetic construct
aggcuaagugaccuucaaggg

SEQ ID NO: 5855 - RNA, 21 nt, Artificial Sequence
  Synthetic construct
ucgggaagcggcaucagggac

SEQ ID NO: 5856 - RNA, 21 nt, Artificial Sequence
  Synthetic construct
uagcagcagcauagguaaagg

SEQ ID NO: 5857 - RNA, 21 nt, Artificial Sequence
  Synthetic construct
aaggcaugggucccuuauggg

SEQ ID NO: 5858 - RNA, 21 nt, Artificial Sequence
  Synthetic construct
ucugcagccuccucucccgcc

SEQ ID NO: 5859 - RNA, 21 nt, Artificial Sequence
  Synthetic construct
gaagcagaccaaucuauggag

SEQ ID NO: 5860 - RNA, 21 nt, Artificial Sequence
  Synthetic construct
augagccuuuaagcagcagca

SEQ ID NO: 5861 - RNA, 21 nt, Artificial Sequence
  Synthetic construct
agcugaauggacgugaggccu

SEQ ID NO: 5862 - RNA, 21 nt, Artificial Sequence
  Synthetic construct
gaaggcuaccucggacuccug

SEQ ID NO: 5863 - RNA, 21 nt, Artificial Sequence
  Synthetic construct
cuguucccuaucucccagcuu

SEQ ID NO: 5864 - RNA, 21 nt, Artificial Sequence
  Synthetic construct
agcucuaacauucugugauuc

SEQ ID NO: 5865 - RNA, 21 nt, Artificial Sequence
  Synthetic construct
agcagcguuagcagcagcaua

SEQ ID NO: 5866 - RNA, 21 nt, Artificial Sequence
  Synthetic construct
ucugggcaccgaccagucccc

SEQ ID NO: 5867 - RNA, 21 nt, Artificial Sequence
  Synthetic construct
aggaagauggacuggacggau

SEQ ID NO: 5868 - RNA, 21 nt, Artificial Sequence
  Synthetic construct
accuggucauuaagcauaggg

SEQ ID NO: 5869 - RNA, 21 nt, Artificial Sequence
  Synthetic construct
gaugcaggcacuuaccucccu

SEQ ID NO: 5870 - RNA, 21 nt, Artificial Sequence
  Synthetic construct
aucugcuggagcccacagaag

SEQ ID NO: 5871 - RNA, 21 nt, Artificial Sequence
  Synthetic construct
cuauuccugcugcacuuccuc

SEQ ID NO: 5872 - RNA, 21 nt, Artificial Sequence
  Synthetic construct
auccugcauuuaaucaguaug

SEQ ID NO: 5873 - RNA, 21 nt, Artificial Sequence
  Synthetic construct
cagaagacacccaccaaggau

SEQ ID NO: 5874 - RNA, 21 nt, Artificial Sequence
  Synthetic construct
acaacaggacaguucacagcc

SEQ ID NO: 5875 - RNA, 21 nt, Artificial Sequence
  Synthetic construct
ugcagccuccucucccgccgc

SEQ ID NO: 5876 - RNA, 21 nt, Artificial Sequence
  Synthetic construct
ucaguccugcuucagaaaggc

SEQ ID NO: 5877 - RNA, 21 nt, Artificial Sequence
  Synthetic construct
acgcugaugcuccacccacuu

SEQ ID NO: 5878 - RNA, 21 nt, Artificial Sequence
  Synthetic construct
cagcagcagcguuagcagcag

SEQ ID NO: 5879 - RNA, 21 nt, Artificial Sequence
  Synthetic construct
gaaccuuccagcccagcuggg

SEQ ID NO: 5880 - RNA, 21 nt, Artificial Sequence
  Synthetic construct
uauggaaccuuccagcccagc

SEQ ID NO: 5881 - RNA, 21 nt, Artificial Sequence
  Synthetic construct
aaauuaguauaagaaucauaa

SEQ ID NO: 5882 - RNA, 21 nt, Artificial Sequence
  Synthetic construct
cuccugaacaugaccuccaag

SEQ ID NO: 5883 - RNA, 21 nt, Artificial Sequence
  Synthetic construct
uccugaccuggagcuugggcu

SEQ ID NO: 5884 - RNA, 21 nt, Artificial Sequence
  Synthetic construct
cuguuuauuauaaagacauau

SEQ ID NO: 5885 - RNA, 21 nt, Artificial Sequence
  Synthetic construct
gcggacauugccgucuuccag

SEQ ID NO: 5886 - RNA, 21 nt, Artificial Sequence
  Synthetic construct
cucugagcaggucacuccccu

SEQ ID NO: 5887 - RNA, 21 nt, Artificial Sequence
  Synthetic construct
cacacacacaaaguugggcau

SEQ ID NO: 5888 - RNA, 21 nt, Artificial Sequence
  Synthetic construct
ccagagaagcagaccaaucua

SEQ ID NO: 5889 - RNA, 21 nt, Artificial Sequence
  Synthetic construct
augugaccuggucauuaagca

SEQ ID NO: 5890 - RNA, 21 nt, Artificial Sequence
  Synthetic construct
aggaaggcccaaaugaagguu

SEQ ID NO: 5891 - RNA, 21 nt, Artificial Sequence
  Synthetic construct
ucucccuuaacugagcaaacg

SEQ ID NO: 5892 - RNA, 21 nt, Artificial Sequence
  Synthetic construct
agcgguagucucagugccuga

SEQ ID NO: 5893 - RNA, 21 nt, Artificial Sequence
  Synthetic construct
ucugcauucuucccuggaggc

SEQ ID NO: 5894 - RNA, 21 nt, Artificial Sequence
  Synthetic construct
uccacccacuucaccagagcu

SEQ ID NO: 5895 - RNA, 21 nt, Artificial Sequence
  Synthetic construct
uacuccugggaggguauauag

SEQ ID NO: 5896 - RNA, 21 nt, Artificial Sequence
  Synthetic construct
cagugauugaaggcuaccucg

SEQ ID NO: 5897 - RNA, 21 nt, Artificial Sequence
  Synthetic construct
gacuuucugggcaccgaccag

SEQ ID NO: 5898 - RNA, 21 nt, Artificial Sequence
  Synthetic construct
cuuuguauaaauuaguauaag

SEQ ID NO: 5899 - RNA, 21 nt, Artificial Sequence
  Synthetic construct
augaacagggccuuaauaucu

SEQ ID NO: 5900 - RNA, 21 nt, Artificial Sequence
  Synthetic construct
acccacuucaccagagcuccu

SEQ ID NO: 5901 - RNA, 21 nt, Artificial Sequence
  Synthetic construct
cuucugcagccuccucucccg

SEQ ID NO: 5902 - RNA, 21 nt, Artificial Sequence
  Synthetic construct
aagauggacuggacggauucu

SEQ ID NO: 5903 - RNA, 21 nt, Artificial Sequence
  Synthetic construct
ugugcccugucuggauccccg

SEQ ID NO: 5904 - RNA, 21 nt, Artificial Sequence
  Synthetic construct
aggcacacuaaggcaagagaa

SEQ ID NO: 5905 - RNA, 21 nt, Artificial Sequence
  Synthetic construct
aguauaagaaucauaaacaac

SEQ ID NO: 5906 - RNA, 21 nt, Artificial Sequence
  Synthetic construct
ugcgggcgcagagcucgggag

SEQ ID NO: 5907 - RNA, 21 nt, Artificial Sequence
  Synthetic construct
augugcccugucuggaucccc

SEQ ID NO: 5908 - RNA, 21 nt, Artificial Sequence
  Synthetic construct
aagagcugggcccacuggugg

SEQ ID NO: 5909 - RNA, 21 nt, Artificial Sequence
  Synthetic construct
agcgccugcacgcagagccgc

SEQ ID NO: 5910 - RNA, 21 nt, Artificial Sequence
  Synthetic construct
uaaaguaggagaugggagacc

SEQ ID NO: 5911 - RNA, 21 nt, Artificial Sequence
  Synthetic construct
auuuccuccgaccucccugcc

SEQ ID NO: 5912 - RNA, 21 nt, Artificial Sequence
  Synthetic construct
gacauugccgucuuccagccc

SEQ ID NO: 5913 - RNA, 21 nt, Artificial Sequence
  Synthetic construct
aaagaaggcccaaucccugau

SEQ ID NO: 5914 - RNA, 21 nt, Artificial Sequence
  Synthetic construct
augcugcuccuugggccgccg

SEQ ID NO: 5915 - RNA, 21 nt, Artificial Sequence
  Synthetic construct
aggagacauaaccgccggggg

SEQ ID NO: 5916 - RNA, 21 nt, Artificial Sequence
  Synthetic construct
aagacauauuuacacagaaca

SEQ ID NO: 5917 - RNA, 21 nt, Artificial Sequence
  Synthetic construct
uccgggagcggcagcggcgag

SEQ ID NO: 5918 - RNA, 21 nt, Artificial Sequence
  Synthetic construct
agaugggagaccuggucccca

SEQ ID NO: 5919 - RNA, 21 nt, Artificial Sequence
  Synthetic construct
ugccucucccuucccuucccc

SEQ ID NO: 5920 - RNA, 21 nt, Artificial Sequence
  Synthetic construct
aagaagggaguauugggaggc

SEQ ID NO: 5921 - RNA, 21 nt, Artificial Sequence
  Synthetic construct
cuggaaggaagguccggucaa

SEQ ID NO: 5922 - RNA, 21 nt, Artificial Sequence
  Synthetic construct
gaacagggccuuaauaucuuu

SEQ ID NO: 5923 - RNA, 21 nt, Artificial Sequence
  Synthetic construct
cccacuucaccagagcuccug

SEQ ID NO: 5924 - RNA, 21 nt, Artificial Sequence
  Synthetic construct
aaagacauauuuacacagaac

SEQ ID NO: 5925 - RNA, 21 nt, Artificial Sequence
  Synthetic construct
gaauuuccuccgaccucccug

SEQ ID NO: 5926 - RNA, 21 nt, Artificial Sequence
  Synthetic construct
uggacggauucuugugagaga

SEQ ID NO: 5927 - RNA, 21 nt, Artificial Sequence
  Synthetic construct
agggcagacaugaggaaggaa

SEQ ID NO: 5928 - RNA, 21 nt, Artificial Sequence
  Synthetic construct
gaggagacauaaccgccgggg

SEQ ID NO: 5929 - RNA, 21 nt, Artificial Sequence
  Synthetic construct
ugcuucagaaaggcauggguc

SEQ ID NO: 5930 - RNA, 21 nt, Artificial Sequence
  Synthetic construct
caaggguccugucagcucuaa

SEQ ID NO: 5931 - RNA, 21 nt, Artificial Sequence
  Synthetic construct
ucuugugagagaacgggaauc

SEQ ID NO: 5932 - RNA, 21 nt, Artificial Sequence
  Synthetic construct
agcagaccaaucuauggagga

SEQ ID NO: 5933 - RNA, 21 nt, Artificial Sequence
  Synthetic construct
gaguccagugauugaaggcua

SEQ ID NO: 5934 - RNA, 21 nt, Artificial Sequence
  Synthetic construct
aggugagaagagcugggccca

SEQ ID NO: 5935 - RNA, 21 nt, Artificial Sequence
  Synthetic construct
uccagcccauucccaucggga

SEQ ID NO: 5936 - RNA, 21 nt, Artificial Sequence
  Synthetic construct
aggcguuugccuaagaaggcu

SEQ ID NO: 5937 - RNA, 21 nt, Artificial Sequence
  Synthetic construct
cccuuaacugagcaaacgcug

SEQ ID NO: 5938 - RNA, 21 nt, Artificial Sequence
  Synthetic construct
cggcucugcaaugacucugag

SEQ ID NO: 5939 - RNA, 21 nt, Artificial Sequence
  Synthetic construct
agggaacaauuucuuaaugaa

SEQ ID NO: 5940 - RNA, 21 nt, Artificial Sequence
  Synthetic construct
ucccggcucugcaaugacucu

SEQ ID NO: 5941 - RNA, 21 nt, Artificial Sequence
  Synthetic construct
cugggaacccugcucaagcaa

SEQ ID NO: 5942 - RNA, 21 nt, Artificial Sequence
  Synthetic construct
agggccuuaauaucuuuguau

SEQ ID NO: 5943 - RNA, 21 nt, Artificial Sequence
  Synthetic construct
agcaugagccuuuaagcagca

SEQ ID NO: 5944 - RNA, 21 nt, Artificial Sequence
  Synthetic construct
ugagaagagcugggcccacug

SEQ ID NO: 5945 - RNA, 21 nt, Artificial Sequence
  Synthetic construct
aguaagggcgaacugucagcu

SEQ ID NO: 5946 - RNA, 21 nt, Artificial Sequence
  Synthetic construct
aaccacuuuaaauaaggcagc

SEQ ID NO: 5947 - RNA, 21 nt, Artificial Sequence
  Synthetic construct
aggucagggaggugggagcag

SEQ ID NO: 5948 - RNA, 21 nt, Artificial Sequence
  Synthetic construct
ugccuaagaaggcuaagugac

SEQ ID NO: 5949 - RNA, 21 nt, Artificial Sequence
  Synthetic construct
ccacacaccgcggucaaggag

SEQ ID NO: 5950 - RNA, 21 nt, Artificial Sequence
  Synthetic construct
cagcucuaacauucugugauu

SEQ ID NO: 5951 - RNA, 21 nt, Artificial Sequence
  Synthetic construct
ugggaggcacacuaaggcaag

SEQ ID NO: 5952 - RNA, 21 nt, Artificial Sequence
  Synthetic construct
ggugagagcugaauggacgug

SEQ ID NO: 5953 - RNA, 21 nt, Artificial Sequence
  Synthetic construct
gagggcgucauaaaguaggag

SEQ ID NO: 5954 - RNA, 21 nt, Artificial Sequence
  Synthetic construct
agcuugccucucccuucccuu

SEQ ID NO: 5955 - RNA, 21 nt, Artificial Sequence
  Synthetic construct
ucuucccuccuuccuucugcc

SEQ ID NO: 5956 - RNA, 21 nt, Artificial Sequence
  Synthetic construct
agaagagcugggcccacuggu

SEQ ID NO: 5957 - RNA, 21 nt, Artificial Sequence
  Synthetic construct
ggaagguccggucaacacgaa

SEQ ID NO: 5958 - RNA, 21 nt, Artificial Sequence
  Synthetic construct
cauuccuugacccucugggcu

SEQ ID NO: 5959 - RNA, 21 nt, Artificial Sequence
  Synthetic construct
augaggcaggagacacagaaa

SEQ ID NO: 5960 - RNA, 21 nt, Artificial Sequence
  Synthetic construct
gcauuuaaucaguauguucuu

SEQ ID NO: 5961 - RNA, 21 nt, Artificial Sequence
  Synthetic construct
cuucccuuccuucuucucccc

SEQ ID NO: 5962 - RNA, 21 nt, Artificial Sequence
  Synthetic construct
cacuacccucuucuguucccu

SEQ ID NO: 5963 - RNA, 21 nt, Artificial Sequence
  Synthetic construct
gacaugaggaaggaaggccca

SEQ ID NO: 5964 - RNA, 21 nt, Artificial Sequence
  Synthetic construct
ugaugcuccacccacuucacc

SEQ ID NO: 5965 - RNA, 21 nt, Artificial Sequence
  Synthetic construct
aaaguaggagaugggagaccu

SEQ ID NO: 5966 - RNA, 21 nt, Artificial Sequence
  Synthetic construct
cacagaagggagcacuuccac

SEQ ID NO: 5967 - RNA, 21 nt, Artificial Sequence
  Synthetic construct
uaauuuagcuuuaaccuccug

SEQ ID NO: 5968 - RNA, 21 nt, Artificial Sequence
  Synthetic construct
uucacauugacaaucaugcag

SEQ ID NO: 5969 - RNA, 21 nt, Artificial Sequence
  Synthetic construct
uuugaguacauccuuuaccau

SEQ ID NO: 5970 - RNA, 21 nt, Artificial Sequence
  Synthetic construct
uucuuguccacaucaauggug

SEQ ID NO: 5971 - RNA, 21 nt, Artificial Sequence
  Synthetic construct
uugacaaucaugcaggaacgg

SEQ ID NO: 5972 - RNA, 21 nt, Artificial Sequence
  Synthetic construct
uagcucugcuuugcacugcug

SEQ ID NO: 5973 - RNA, 21 nt, Artificial Sequence
  Synthetic construct
uaggucauaaagcaguucguu

SEQ ID NO: 5974 - RNA, 21 nt, Artificial Sequence
  Synthetic construct
aacuacgacaucgucaucgga

SEQ ID NO: 5975 - RNA, 21 nt, Artificial Sequence
  Synthetic construct
uaccugaagacuauguuccuu

SEQ ID NO: 5976 - RNA, 21 nt, Artificial Sequence
  Synthetic construct
uugaugguaccuugaaucgug

SEQ ID NO: 5977 - RNA, 21 nt, Artificial Sequence
  Synthetic construct
uuuccugcuuccuucaaccgu

SEQ ID NO: 5978 - RNA, 21 nt, Artificial Sequence
  Synthetic construct
uaagaugucaucacaaguggu

SEQ ID NO: 5979 - RNA, 21 nt, Artificial Sequence
  Synthetic construct
uuacucacaccuagucgccga

SEQ ID NO: 5980 - RNA, 21 nt, Artificial Sequence
  Synthetic construct
uugcacaugaauccaguugag

SEQ ID NO: 5981 - RNA, 21 nt, Artificial Sequence
  Synthetic construct
uucgauguagacacuccucuu

SEQ ID NO: 5982 - RNA, 21 nt, Artificial Sequence
  Synthetic construct
ucugauagcagguucuugcgu

SEQ ID NO: 5983 - RNA, 21 nt, Artificial Sequence
  Synthetic construct
uucaccacucuucugaucuuu

SEQ ID NO: 5984 - RNA, 21 nt, Artificial Sequence
  Synthetic construct
ucgaugacuuguuucauccag

SEQ ID NO: 5985 - RNA, 21 nt, Artificial Sequence
  Synthetic construct
uuuaaccuccugaagcugcug

SEQ ID NO: 5986 - RNA, 21 nt, Artificial Sequence
  Synthetic construct
uuguagaucucaaagaaugag

SEQ ID NO: 5987 - RNA, 21 nt, Artificial Sequence
  Synthetic construct
uugagaucuuucacauaggga

SEQ ID NO: 5988 - RNA, 21 nt, Artificial Sequence
  Synthetic construct
aauaucuuuaauauaacuguu

SEQ ID NO: 5989 - RNA, 21 nt, Artificial Sequence
  Synthetic construct
uacgacaucgucaucggacag

SEQ ID NO: 5990 - RNA, 21 nt, Artificial Sequence
  Synthetic construct
uucuaauaggucauaaagcag

SEQ ID NO: 5991 - RNA, 21 nt, Artificial Sequence
  Synthetic construct
uuucaacacaguaugauacug

SEQ ID NO: 5992 - RNA, 21 nt, Artificial Sequence
  Synthetic construct
augacuuguuucauccagcug

SEQ ID NO: 5993 - RNA, 21 nt, Artificial Sequence
  Synthetic construct
uggaacacucgagucaacuug

SEQ ID NO: 5994 - RNA, 21 nt, Artificial Sequence
  Synthetic construct
uacauccuuuaccaucuccuu

SEQ ID NO: 5995 - RNA, 21 nt, Artificial Sequence
  Synthetic construct
aucugcuugcugucuagccag

SEQ ID NO: 5996 - RNA, 21 nt, Artificial Sequence
  Synthetic construct
aacacucgagucaacuugcug

SEQ ID NO: 5997 - RNA, 21 nt, Artificial Sequence
  Synthetic construct
uucacugcaccacuguucccg

SEQ ID NO: 5998 - RNA, 21 nt, Artificial Sequence
  Synthetic construct
uuaugcaacucuucaguggua

SEQ ID NO: 5999 - RNA, 21 nt, Artificial Sequence
  Synthetic construct
uuggaggcuauugaagaucag

SEQ ID NO: 6000 - RNA, 21 nt, Artificial Sequence
  Synthetic construct
uucaggagaguagcugaccca

SEQ ID NO: 6001 - RNA, 21 nt, Artificial Sequence
  Synthetic construct
uauaauuccugauauauggua

SEQ ID NO: 6002 - RNA, 21 nt, Artificial Sequence
  Synthetic construct
uugauuaagaugucaucacaa

SEQ ID NO: 6003 - RNA, 21 nt, Artificial Sequence
  Synthetic construct
ucacagagugacagcucgcug

SEQ ID NO: 6004 - RNA, 21 nt, Artificial Sequence
  Synthetic construct
uuccacaacuuguaggagcuc

SEQ ID NO: 6005 - RNA, 21 nt, Artificial Sequence
  Synthetic construct
uuguagaacaagggucuccac

SEQ ID NO: 6006 - RNA, 21 nt, Artificial Sequence
  Synthetic construct
uuucacuagcaccauguuguu

SEQ ID NO: 6007 - RNA, 21 nt, Artificial Sequence
  Synthetic construct
uuuaccaucuccuucacaguu

SEQ ID NO: 6008 - RNA, 21 nt, Artificial Sequence
  Synthetic construct
uguucuaccaucucauugcaa

SEQ ID NO: 6009 - RNA, 21 nt, Artificial Sequence
  Synthetic construct
uaauaucuuuaauauaacugu

SEQ ID NO: 6010 - RNA, 21 nt, Artificial Sequence
  Synthetic construct
uuguccucuagggagguagag

SEQ ID NO: 6011 - RNA, 21 nt, Artificial Sequence
  Synthetic construct
uuucugaagcucuguccgcaa

SEQ ID NO: 6012 - RNA, 21 nt, Artificial Sequence
  Synthetic construct
uucuucauuuccuccugucgg

SEQ ID NO: 6013 - RNA, 21 nt, Artificial Sequence
  Synthetic construct
aucucggagaugcaucuccag

SEQ ID NO: 6014 - RNA, 21 nt, Artificial Sequence
  Synthetic construct
uacuuaugcaacucuucagug

SEQ ID NO: 6015 - RNA, 21 nt, Artificial Sequence
  Synthetic construct
uagcaccauguuguucugcag

SEQ ID NO: 6016 - RNA, 21 nt, Artificial Sequence
  Synthetic construct
auacaugcugccuucuuccga

SEQ ID NO: 6017 - RNA, 21 nt, Artificial Sequence
  Synthetic construct
uuagguugaagaaggaugccu

SEQ ID NO: 6018 - RNA, 21 nt, Artificial Sequence
  Synthetic construct
ucugauacuuaugcaacucuu

SEQ ID NO: 6019 - RNA, 21 nt, Artificial Sequence
  Synthetic construct
uuaagaugucaucacaagugg

SEQ ID NO: 6020 - RNA, 21 nt, Artificial Sequence
  Synthetic construct
ugcacugcuguaauuuagcuu

SEQ ID NO: 6021 - RNA, 21 nt, Artificial Sequence
  Synthetic construct
uauacuuucaccuucuccaua

SEQ ID NO: 6022 - RNA, 21 nt, Artificial Sequence
  Synthetic construct
uuucgauguagacacuccucu

SEQ ID NO: 6023 - RNA, 21 nt, Artificial Sequence
  Synthetic construct
uuuagcucugcuuugcacugc

SEQ ID NO: 6024 - RNA, 21 nt, Artificial Sequence
  Synthetic construct
ucggagaugcaucuccagcug

SEQ ID NO: 6025 - RNA, 21 nt, Artificial Sequence
  Synthetic construct
uacugcugguacacugacuga

SEQ ID NO: 6026 - RNA, 21 nt, Artificial Sequence
  Synthetic construct
uucguuguagaucucaaagaa

SEQ ID NO: 6027 - RNA, 21 nt, Artificial Sequence
  Synthetic construct
uagaacaagggucuccacauu

SEQ ID NO: 6028 - RNA, 21 nt, Artificial Sequence
  Synthetic construct
uucaucucggagaugcaucuc

SEQ ID NO: 6029 - RNA, 21 nt, Artificial Sequence
  Synthetic construct
uaacuucuuguccacaucaau

SEQ ID NO: 6030 - RNA, 21 nt, Artificial Sequence
  Synthetic construct
uucagugguagaguuuagcuc

SEQ ID NO: 6031 - RNA, 21 nt, Artificial Sequence
  Synthetic construct
ucucaauacggacacaacccu

SEQ ID NO: 6032 - RNA, 21 nt, Artificial Sequence
  Synthetic construct
uagcagggacagcuucuucau

SEQ ID NO: 6033 - RNA, 21 nt, Artificial Sequence
  Synthetic construct
ugucugaguauugcauccugg

SEQ ID NO: 6034 - RNA, 21 nt, Artificial Sequence
  Synthetic construct
auuucuucaggagaguagcug

SEQ ID NO: 6035 - RNA, 21 nt, Artificial Sequence
  Synthetic construct
auccugauugagaagaugcug

SEQ ID NO: 6036 - RNA, 21 nt, Artificial Sequence
  Synthetic construct
uucugguugaggugggugcug

SEQ ID NO: 6037 - RNA, 21 nt, Artificial Sequence
  Synthetic construct
uugucagugacuccuugagga

SEQ ID NO: 6038 - RNA, 21 nt, Artificial Sequence
  Synthetic construct
uuccugucguuccaacucuga

SEQ ID NO: 6039 - RNA, 21 nt, Artificial Sequence
  Synthetic construct
ugacagcucgcugaucuuggg

SEQ ID NO: 6040 - RNA, 21 nt, Artificial Sequence
  Synthetic construct
ucugaagguaacaagggccua

SEQ ID NO: 6041 - RNA, 21 nt, Artificial Sequence
  Synthetic construct
uaucuuuaauauaacuguuuu

SEQ ID NO: 6042 - RNA, 21 nt, Artificial Sequence
  Synthetic construct
uuaaccuccugaagcugcugg

SEQ ID NO: 6043 - RNA, 21 nt, Artificial Sequence
  Synthetic construct
ugucguuccaacucugaaggu

SEQ ID NO: 6044 - RNA, 21 nt, Artificial Sequence
  Synthetic construct
uagacacuccucuucaaggaa

SEQ ID NO: 6045 - RNA, 21 nt, Artificial Sequence
  Synthetic construct
uuccuugaugaacgagugcag

SEQ ID NO: 6046 - RNA, 21 nt, Artificial Sequence
  Synthetic construct
auaucuuuaauauaacuguuu

SEQ ID NO: 6047 - RNA, 21 nt, Artificial Sequence
  Synthetic construct
aucucaaagaaugagauccag

SEQ ID NO: 6048 - RNA, 21 nt, Artificial Sequence
  Synthetic construct
uuuagcuuuaaccuccugaag

SEQ ID NO: 6049 - RNA, 21 nt, Artificial Sequence
  Synthetic construct
uaaccuccugaagcugcuggg

SEQ ID NO: 6050 - RNA, 21 nt, Artificial Sequence
  Synthetic construct
uacucacaccuagucgccgaa

SEQ ID NO: 6051 - RNA, 21 nt, Artificial Sequence
  Synthetic construct
uugcaucuguucuaccaucuc

SEQ ID NO: 6052 - RNA, 21 nt, Artificial Sequence
  Synthetic construct
uuccugcuuccuucaaccguu

SEQ ID NO: 6053 - RNA, 21 nt, Artificial Sequence
  Synthetic construct
ugacugauagaagagagccca

SEQ ID NO: 6054 - RNA, 21 nt, Artificial Sequence
  Synthetic construct
ucuucauuuccuccugucgga

SEQ ID NO: 6055 - RNA, 21 nt, Artificial Sequence
  Synthetic construct
uagucgccgaagcuggacuuu

SEQ ID NO: 6056 - RNA, 21 nt, Artificial Sequence
  Synthetic construct
uugaugaacgagugcagggau

SEQ ID NO: 6057 - RNA, 21 nt, Artificial Sequence
  Synthetic construct
uuucaucauagguagaugcac

SEQ ID NO: 6058 - RNA, 21 nt, Artificial Sequence
  Synthetic construct
uagguugaagaaggaugccug

SEQ ID NO: 6059 - RNA, 21 nt, Artificial Sequence
  Synthetic construct
ugacuuguuucauccagcugg

SEQ ID NO: 6060 - RNA, 21 nt, Artificial Sequence
  Synthetic construct
uucacuagcaccauguuguuc

SEQ ID NO: 6061 - RNA, 21 nt, Artificial Sequence
  Synthetic construct
ucuucugaucuuugcagcgcu

SEQ ID NO: 6062 - RNA, 21 nt, Artificial Sequence
  Synthetic construct
ugguagaguuuagcucugcuu

SEQ ID NO: 6063 - RNA, 21 nt, Artificial Sequence
  Synthetic construct
ucugaguauugcauccuggau

SEQ ID NO: 6064 - RNA, 21 nt, Artificial Sequence
  Synthetic construct
auaauaucuuuaauauaacug

SEQ ID NO: 6065 - RNA, 21 nt, Artificial Sequence
  Synthetic construct
uagcagguucuugcguaccac

SEQ ID NO: 6066 - RNA, 21 nt, Artificial Sequence
  Synthetic construct
uuccuccugucggaucugcuu

SEQ ID NO: 6067 - RNA, 21 nt, Artificial Sequence
  Synthetic construct
uuagcucugcuuugcacugcu

SEQ ID NO: 6068 - RNA, 21 nt, Artificial Sequence
  Synthetic construct
aacccugaucuuccugucguu

SEQ ID NO: 6069 - RNA, 21 nt, Artificial Sequence
  Synthetic construct
uaggcgguucuaauaggucau

SEQ ID NO: 6070 - RNA, 21 nt, Artificial Sequence
  Synthetic construct
ucaucggacagcaagcccgcu

SEQ ID NO: 6071 - RNA, 21 nt, Artificial Sequence
  Synthetic construct
auucacauugacaaucaugca

SEQ ID NO: 6072 - RNA, 21 nt, Artificial Sequence
  Synthetic construct
uaaauuucgaaggaaugguuu

SEQ ID NO: 6073 - RNA, 21 nt, Artificial Sequence
  Synthetic construct
ucuugcacaugaauccaguug

SEQ ID NO: 6074 - RNA, 21 nt, Artificial Sequence
  Synthetic construct
uuggaggccuccauuuagcag

SEQ ID NO: 6075 - RNA, 21 nt, Artificial Sequence
  Synthetic construct
uccugucggaucugcuugcug

SEQ ID NO: 6076 - RNA, 21 nt, Artificial Sequence
  Synthetic construct
uuggagagacucaccaaguuu

SEQ ID NO: 6077 - RNA, 21 nt, Artificial Sequence
  Synthetic construct
ucgauguagacacuccucuuc

SEQ ID NO: 6078 - RNA, 21 nt, Artificial Sequence
  Synthetic construct
uugcacugcuguaauuuagcu

SEQ ID NO: 6079 - RNA, 21 nt, Artificial Sequence
  Synthetic construct
aagcucucucugcugauugga

SEQ ID NO: 6080 - RNA, 21 nt, Artificial Sequence
  Synthetic construct
uacaugcugccuucuuccgaa

SEQ ID NO: 6081 - RNA, 21 nt, Artificial Sequence
  Synthetic construct
uacugcucagcaauacaugcu

SEQ ID NO: 6082 - RNA, 21 nt, Artificial Sequence
  Synthetic construct
auugagaagaugcugugacug

SEQ ID NO: 6083 - RNA, 21 nt, Artificial Sequence
  Synthetic construct
aacuuguaggagcuccucuuu

SEQ ID NO: 6084 - RNA, 21 nt, Artificial Sequence
  Synthetic construct
uagagacgacagagcagucug

SEQ ID NO: 6085 - RNA, 21 nt, Artificial Sequence
  Synthetic construct
uaauaggucauaaagcaguuc

SEQ ID NO: 6086 - RNA, 21 nt, Artificial Sequence
  Synthetic construct
uuggaguuucaacacaguaug

SEQ ID NO: 6087 - RNA, 21 nt, Artificial Sequence
  Synthetic construct
uuaccaucuccuucacaguua

SEQ ID NO: 6088 - RNA, 21 nt, Artificial Sequence
  Synthetic construct
uccauauguauagaugagcca

SEQ ID NO: 6089 - RNA, 21 nt, Artificial Sequence
  Synthetic construct
ugcaucuguucuaccaucuca

SEQ ID NO: 6090 - RNA, 21 nt, Artificial Sequence
  Synthetic construct
aucacagagugacagcucgcu

SEQ ID NO: 6091 - RNA, 21 nt, Artificial Sequence
  Synthetic construct
ugcuuguagaacaagggucuc

SEQ ID NO: 6092 - RNA, 21 nt, Artificial Sequence
  Synthetic construct
uucuugcguaccacagacccc

SEQ ID NO: 6093 - RNA, 21 nt, Artificial Sequence
  Synthetic construct
uagccgcaaagucugccucuu

SEQ ID NO: 6094 - RNA, 21 nt, Artificial Sequence
  Synthetic construct
uuugugaccgccguagggcca

SEQ ID NO: 6095 - RNA, 21 nt, Artificial Sequence
  Synthetic construct
augcaucuccagcuguagcuu

SEQ ID NO: 6096 - RNA, 21 nt, Artificial Sequence
  Synthetic construct
agcucuguccgcaacagccuu

SEQ ID NO: 6097 - RNA, 21 nt, Artificial Sequence
  Synthetic construct
uuugccgggacagguaguggg

SEQ ID NO: 6098 - RNA, 21 nt, Artificial Sequence
  Synthetic construct
uacggacacaacccugaucuu

SEQ ID NO: 6099 - RNA, 21 nt, Artificial Sequence
  Synthetic construct
ucuuccugucguuccaacucu

SEQ ID NO: 6100 - RNA, 21 nt, Artificial Sequence
  Synthetic construct
uguuguucugcaguucagcca

SEQ ID NO: 6101 - RNA, 21 nt, Artificial Sequence
  Synthetic construct
uacacugacugauagaagaga

SEQ ID NO: 6102 - RNA, 21 nt, Artificial Sequence
  Synthetic construct
aagaaugagauccagauggag

SEQ ID NO: 6103 - RNA, 21 nt, Artificial Sequence
  Synthetic construct
aacagccuuauauucuucugg

SEQ ID NO: 6104 - RNA, 21 nt, Artificial Sequence
  Synthetic construct
ucauagguagaugcacaggga

SEQ ID NO: 6105 - RNA, 21 nt, Artificial Sequence
  Synthetic construct
ucuugcguaccacagacccca

SEQ ID NO: 6106 - RNA, 21 nt, Artificial Sequence
  Synthetic construct
aucuuuaauauaacuguuuuu

SEQ ID NO: 6107 - RNA, 21 nt, Artificial Sequence
  Synthetic construct
uucugaucuuugcagcgcucu

SEQ ID NO: 6108 - RNA, 21 nt, Artificial Sequence
  Synthetic construct
agaaaccuuggaacacucgag

SEQ ID NO: 6109 - RNA, 21 nt, Artificial Sequence
  Synthetic construct
uuggaacacucgagucaacuu

SEQ ID NO: 6110 - RNA, 21 nt, Artificial Sequence
  Synthetic construct
auugcaaauuucaucucggag

SEQ ID NO: 6111 - RNA, 21 nt, Artificial Sequence
  Synthetic construct
uguaggagcuccucuuugcca

SEQ ID NO: 6112 - RNA, 21 nt, Artificial Sequence
  Synthetic construct
ugcaucuccagcuguagcuuu

SEQ ID NO: 6113 - RNA, 21 nt, Artificial Sequence
  Synthetic construct
uucuucaggagaguagcugac

SEQ ID NO: 6114 - RNA, 21 nt, Artificial Sequence
  Synthetic construct
ucaccuucuccauacuguccu

SEQ ID NO: 6115 - RNA, 21 nt, Artificial Sequence
  Synthetic construct
uuagugacuccauauguauag

SEQ ID NO: 6116 - RNA, 21 nt, Artificial Sequence
  Synthetic construct
ugaagaaggaugccuguccca

SEQ ID NO: 6117 - RNA, 21 nt, Artificial Sequence
  Synthetic construct
aauuucaucucggagaugcau

SEQ ID NO: 6118 - RNA, 21 nt, Artificial Sequence
  Synthetic construct
aagcucuguccgcaacagccu

SEQ ID NO: 6119 - RNA, 21 nt, Artificial Sequence
  Synthetic construct
ucucauugcaaauuucaucuc

SEQ ID NO: 6120 - RNA, 21 nt, Artificial Sequence
  Synthetic construct
ucauugcaaauuucaucucgg

SEQ ID NO: 6121 - RNA, 21 nt, Artificial Sequence
  Synthetic construct
uugccgggacagguagugggg

SEQ ID NO: 6122 - RNA, 21 nt, Artificial Sequence
  Synthetic construct
ucggaucugcuugcugucuag

SEQ ID NO: 6123 - RNA, 21 nt, Artificial Sequence
  Synthetic construct
acauugacaaucaugcaggaa

SEQ ID NO: 6124 - RNA, 21 nt, Artificial Sequence
  Synthetic construct
uaugcaacucuucagugguag

SEQ ID NO: 6125 - RNA, 21 nt, Artificial Sequence
  Synthetic construct
uaccucauuggagagcaaggg

SEQ ID NO: 6126 - RNA, 21 nt, Artificial Sequence
  Synthetic construct
aaguuucugaagcucuguccg

SEQ ID NO: 6127 - RNA, 21 nt, Artificial Sequence
  Synthetic construct
aagaaaccuuggaacacucga

SEQ ID NO: 6128 - RNA, 21 nt, Artificial Sequence
  Synthetic construct
uauuucuucaggagaguagcu

SEQ ID NO: 6129 - RNA, 21 nt, Artificial Sequence
  Synthetic construct
augugaacaauaauaucuuua

SEQ ID NO: 6130 - RNA, 21 nt, Artificial Sequence
  Synthetic construct
ugauagaagagagcccagcaa

SEQ ID NO: 6131 - RNA, 21 nt, Artificial Sequence
  Synthetic construct
ucuaacuucuuguccacauca

SEQ ID NO: 6132 - RNA, 21 nt, Artificial Sequence
  Synthetic construct
aauaucaucaucaaggccugu

SEQ ID NO: 6133 - RNA, 21 nt, Artificial Sequence
  Synthetic construct
ucugaucuuugcagcgcucug

SEQ ID NO: 6134 - RNA, 21 nt, Artificial Sequence
  Synthetic construct
ucuucuaacuucuuguccaca

SEQ ID NO: 6135 - RNA, 21 nt, Artificial Sequence
  Synthetic construct
ugguaccuugaaucguguggg

SEQ ID NO: 6136 - RNA, 21 nt, Artificial Sequence
  Synthetic construct
uuucuucaggagaguagcuga

SEQ ID NO: 6137 - RNA, 21 nt, Artificial Sequence
  Synthetic construct
acacaguaugauacugcucag

SEQ ID NO: 6138 - RNA, 21 nt, Artificial Sequence
  Synthetic construct
uuuagcagggacagcuucuuc

SEQ ID NO: 6139 - RNA, 21 nt, Artificial Sequence
  Synthetic construct
uagcuuuaaccuccugaagcu

SEQ ID NO: 6140 - RNA, 21 nt, Artificial Sequence
  Synthetic construct
aucuguucuaccaucucauug

SEQ ID NO: 6141 - RNA, 21 nt, Artificial Sequence
  Synthetic construct
aucgaugacuuguuucaucca

SEQ ID NO: 6142 - RNA, 21 nt, Artificial Sequence
  Synthetic construct
ugaucuuugcagcgcucugag

SEQ ID NO: 6143 - RNA, 21 nt, Artificial Sequence
  Synthetic construct
uccuccugucggaucugcuug

SEQ ID NO: 6144 - RNA, 21 nt, Artificial Sequence
  Synthetic construct
uuugauuaagaugucaucaca

SEQ ID NO: 6145 - RNA, 21 nt, Artificial Sequence
  Synthetic construct
augaauccaguugagaucuuu

SEQ ID NO: 6146 - RNA, 21 nt, Artificial Sequence
  Synthetic construct
agcuucuagcucuucaaucuu

SEQ ID NO: 6147 - RNA, 21 nt, Artificial Sequence
  Synthetic construct
uuguaggagcuccucuuugcc

SEQ ID NO: 6148 - RNA, 21 nt, Artificial Sequence
  Synthetic construct
aucuccuucacaguuagguug

SEQ ID NO: 6149 - RNA, 21 nt, Artificial Sequence
  Synthetic construct
ugucagugacuccuugaggau

SEQ ID NO: 6150 - RNA, 21 nt, Artificial Sequence
  Synthetic construct
uucuccauacuguccucagau

SEQ ID NO: 6151 - RNA, 21 nt, Artificial Sequence
  Synthetic construct
aucuugcacaugaauccaguu

SEQ ID NO: 6152 - RNA, 21 nt, Artificial Sequence
  Synthetic construct
agcaucuugcacaugaaucca

SEQ ID NO: 6153 - RNA, 21 nt, Artificial Sequence
  Synthetic construct
uucacaguuagguugaagaag

SEQ ID NO: 6154 - RNA, 21 nt, Artificial Sequence
  Synthetic construct
agugacagcucgcugaucuug

SEQ ID NO: 6155 - RNA, 21 nt, Artificial Sequence
  Synthetic construct
uaacaagggccuaacccucaa

SEQ ID NO: 6156 - RNA, 21 nt, Artificial Sequence
  Synthetic construct
uagaguuuagcucugcuuugc

SEQ ID NO: 6157 - RNA, 21 nt, Artificial Sequence
  Synthetic construct
augaagaguuucaucauaggu

SEQ ID NO: 6158 - RNA, 21 nt, Artificial Sequence
  Synthetic construct
acugcugguacacugacugau

SEQ ID NO: 6159 - RNA, 21 nt, Artificial Sequence
  Synthetic construct
ugcugcuuguccucuagggag

SEQ ID NO: 6160 - RNA, 21 nt, Artificial Sequence
  Synthetic construct
ucaucauagguagaugcacag

SEQ ID NO: 6161 - RNA, 21 nt, Artificial Sequence
  Synthetic construct
uugaguacauccuuuaccauc

SEQ ID NO: 6162 - RNA, 21 nt, Artificial Sequence
  Synthetic construct
uggacuuucgcagccgcagag

SEQ ID NO: 6163 - RNA, 21 nt, Artificial Sequence
  Synthetic construct
aacucugaagguaacaagggc

SEQ ID NO: 6164 - RNA, 21 nt, Artificial Sequence
  Synthetic construct
ugagaagaugcugugacugcg

SEQ ID NO: 6165 - RNA, 21 nt, Artificial Sequence
  Synthetic construct
ugcaacucuucagugguagag

SEQ ID NO: 6166 - RNA, 21 nt, Artificial Sequence
  Synthetic construct
uuguccacaucaauggugaag

SEQ ID NO: 6167 - RNA, 21 nt, Artificial Sequence
  Synthetic construct
accagguucugcuuugaccgg

SEQ ID NO: 6168 - RNA, 21 nt, Artificial Sequence
  Synthetic construct
auaggucauaaagcaguucgu

SEQ ID NO: 6169 - RNA, 21 nt, Artificial Sequence
  Synthetic construct
uuagcagggacagcuucuuca

SEQ ID NO: 6170 - RNA, 21 nt, Artificial Sequence
  Synthetic construct
uucaacacaguaugauacugc

SEQ ID NO: 6171 - RNA, 21 nt, Artificial Sequence
  Synthetic construct
aaguggucaaggcuugacgaa

SEQ ID NO: 6172 - RNA, 21 nt, Artificial Sequence
  Synthetic construct
cuaacuucuuguccacaucaa

SEQ ID NO: 6173 - RNA, 21 nt, Artificial Sequence
  Synthetic construct
agcuuuaaccuccugaagcug

SEQ ID NO: 6174 - RNA, 21 nt, Artificial Sequence
  Synthetic construct
uagaugcacagggauucacau

SEQ ID NO: 6175 - RNA, 21 nt, Artificial Sequence
  Synthetic construct
auuaagaugucaucacaagug

SEQ ID NO: 6176 - RNA, 21 nt, Artificial Sequence
  Synthetic construct
ugguuguugguuugguugcug

SEQ ID NO: 6177 - RNA, 21 nt, Artificial Sequence
  Synthetic construct
uaagggcugcagucuguugag

SEQ ID NO: 6178 - RNA, 21 nt, Artificial Sequence
  Synthetic construct
auaccugaagacuauguuccu

SEQ ID NO: 6179 - RNA, 21 nt, Artificial Sequence
  Synthetic construct
ugaagaguuucaucauaggua

SEQ ID NO: 6180 - RNA, 21 nt, Artificial Sequence
  Synthetic construct
aagacuauguuccuugaugaa

SEQ ID NO: 6181 - RNA, 21 nt, Artificial Sequence
  Synthetic construct
ugcuuugaccgguucugcugg

SEQ ID NO: 6182 - RNA, 21 nt, Artificial Sequence
  Synthetic construct
uggaguuucaacacaguauga

SEQ ID NO: 6183 - RNA, 21 nt, Artificial Sequence
  Synthetic construct
ucauaaagcaguucguuguag

SEQ ID NO: 6184 - RNA, 21 nt, Artificial Sequence
  Synthetic construct
acuuucgauguagacacuccu

SEQ ID NO: 6185 - RNA, 21 nt, Artificial Sequence
  Synthetic construct
aucauagguagaugcacaggg

SEQ ID NO: 6186 - RNA, 21 nt, Artificial Sequence
  Synthetic construct
uccaguuucacuagcaccaug

SEQ ID NO: 6187 - RNA, 21 nt, Artificial Sequence
  Synthetic construct
aaacaugggagaaacuacgac

SEQ ID NO: 6188 - RNA, 21 nt, Artificial Sequence
  Synthetic construct
aaccuuggaacacucgaguca

SEQ ID NO: 6189 - RNA, 21 nt, Artificial Sequence
  Synthetic construct
aacaacaugagauuacauagg

SEQ ID NO: 6190 - RNA, 21 nt, Artificial Sequence
  Synthetic construct
ugccuucuuccgaagguccag

SEQ ID NO: 6191 - RNA, 21 nt, Artificial Sequence
  Synthetic construct
uuucgcagccgcagagcacaa

SEQ ID NO: 6192 - RNA, 21 nt, Artificial Sequence
  Synthetic construct
auacuuaugcaacucuucagu

SEQ ID NO: 6193 - RNA, 21 nt, Artificial Sequence
  Synthetic construct
uccugauauaugguaaagcau

SEQ ID NO: 6194 - RNA, 21 nt, Artificial Sequence
  Synthetic construct
aauguuuccugcuuccuucaa

SEQ ID NO: 6195 - RNA, 21 nt, Artificial Sequence
  Synthetic construct
uggaaccugcugcuuguccuc

SEQ ID NO: 6196 - RNA, 21 nt, Artificial Sequence
  Synthetic construct
aaaccuuggaacacucgaguc

SEQ ID NO: 6197 - RNA, 21 nt, Artificial Sequence
  Synthetic construct
aacaugagauuacauaggugg

SEQ ID NO: 6198 - RNA, 21 nt, Artificial Sequence
  Synthetic construct
augacugcucuucucuuuccc

SEQ ID NO: 6199 - RNA, 21 nt, Artificial Sequence
  Synthetic construct
agguguaggauccugauugag

SEQ ID NO: 6200 - RNA, 21 nt, Artificial Sequence
  Synthetic construct
ucaaggaaguggacagcuccu

SEQ ID NO: 6201 - RNA, 21 nt, Artificial Sequence
  Synthetic construct
uuaauguuuccugcuuccuuc

SEQ ID NO: 6202 - RNA, 21 nt, Artificial Sequence
  Synthetic construct
caacaugagauuacauaggug

SEQ ID NO: 6203 - RNA, 21 nt, Artificial Sequence
  Synthetic construct
aagcaguucguuguagaucuc

SEQ ID NO: 6204 - RNA, 21 nt, Artificial Sequence
  Synthetic construct
ugagaucuuucacauagggau

SEQ ID NO: 6205 - RNA, 21 nt, Artificial Sequence
  Synthetic construct
ugaagguguaggauccugauu

SEQ ID NO: 6206 - RNA, 21 nt, Artificial Sequence
  Synthetic construct
aacaauaauaucuuuaauaua

SEQ ID NO: 6207 - RNA, 21 nt, Artificial Sequence
  Synthetic construct
auuuagcagggacagcuucuu

SEQ ID NO: 6208 - RNA, 21 nt, Artificial Sequence
  Synthetic construct
uugaagaaggaugccuguccc

SEQ ID NO: 6209 - RNA, 21 nt, Artificial Sequence
  Synthetic construct
uacauggagaugucagcuuca

SEQ ID NO: 6210 - RNA, 21 nt, Artificial Sequence
  Synthetic construct
auauaauuccugauauauggu

SEQ ID NO: 6211 - RNA, 21 nt, Artificial Sequence
  Synthetic construct
ugcaagagagcuucuagcucu

SEQ ID NO: 6212 - RNA, 21 nt, Artificial Sequence
  Synthetic construct
uaacccucaaguauacuuuca

SEQ ID NO: 6213 - RNA, 21 nt, Artificial Sequence
  Synthetic construct
cugaucuuccugucguuccaa

SEQ ID NO: 6214 - RNA, 21 nt, Artificial Sequence
  Synthetic construct
ugcagcuguggacucaaacau

SEQ ID NO: 6215 - RNA, 21 nt, Artificial Sequence
  Synthetic construct
uagggagguagagacgacaga

SEQ ID NO: 6216 - RNA, 21 nt, Artificial Sequence
  Synthetic construct
aaauguucacugcaccacugu

SEQ ID NO: 6217 - RNA, 21 nt, Artificial Sequence
  Synthetic construct
uugugaccgccguagggccaa

SEQ ID NO: 6218 - RNA, 21 nt, Artificial Sequence
  Synthetic construct
uccauuuagcagggacagcuu

SEQ ID NO: 6219 - RNA, 21 nt, Artificial Sequence
  Synthetic construct
uccaguugagaucuuucacau

SEQ ID NO: 6220 - RNA, 21 nt, Artificial Sequence
  Synthetic construct
ugaugguaccuugaaucgugu

SEQ ID NO: 6221 - RNA, 21 nt, Artificial Sequence
  Synthetic construct
uugaccgguucugcugguuuu

SEQ ID NO: 6222 - RNA, 21 nt, Artificial Sequence
  Synthetic construct
acaacaugagauuacauaggu

SEQ ID NO: 6223 - RNA, 21 nt, Artificial Sequence
  Synthetic construct
uggacagcuccuccucuugga

SEQ ID NO: 6224 - RNA, 21 nt, Artificial Sequence
  Synthetic construct
agugucugaguauugcauccu

SEQ ID NO: 6225 - RNA, 21 nt, Artificial Sequence
  Synthetic construct
uccugucguuccaacucugaa

SEQ ID NO: 6226 - RNA, 21 nt, Artificial Sequence
  Synthetic construct
ugucggaucugcuugcugucu

SEQ ID NO: 6227 - RNA, 21 nt, Artificial Sequence
  Synthetic construct
uaccaucuccuucacaguuag

SEQ ID NO: 6228 - RNA, 21 nt, Artificial Sequence
  Synthetic construct
ugcccuuugaguacauccuuu

SEQ ID NO: 6229 - RNA, 21 nt, Artificial Sequence
  Synthetic construct
aauacaugcugccuucuuccg

SEQ ID NO: 6230 - RNA, 21 nt, Artificial Sequence
  Synthetic construct
ucuuugcagcgcucugagcca

SEQ ID NO: 6231 - RNA, 21 nt, Artificial Sequence
  Synthetic construct
ucacauugacaaucaugcagg

SEQ ID NO: 6232 - RNA, 21 nt, Artificial Sequence
  Synthetic construct
ucaacacaguaugauacugcu

SEQ ID NO: 6233 - RNA, 21 nt, Artificial Sequence
  Synthetic construct
aaguggacagcuccuccucuu

SEQ ID NO: 6234 - RNA, 21 nt, Artificial Sequence
  Synthetic construct
uuucaccuucuccauacuguc

SEQ ID NO: 6235 - RNA, 21 nt, Artificial Sequence
  Synthetic construct
ugcugguaccuauccgacuuu

SEQ ID NO: 6236 - RNA, 21 nt, Artificial Sequence
  Synthetic construct
ucggccugugaagaaaccuug

SEQ ID NO: 6237 - RNA, 21 nt, Artificial Sequence
  Synthetic construct
uaauguuuccugcuuccuuca

SEQ ID NO: 6238 - RNA, 21 nt, Artificial Sequence
  Synthetic construct
aacaagggucuccacauucuc

SEQ ID NO: 6239 - RNA, 21 nt, Artificial Sequence
  Synthetic construct
auccuggauauaauuccugau

SEQ ID NO: 6240 - RNA, 21 nt, Artificial Sequence
  Synthetic construct
aaucccuccauccuugauggu

SEQ ID NO: 6241 - RNA, 21 nt, Artificial Sequence
  Synthetic construct
cuugaugguaccuugaaucgu

SEQ ID NO: 6242 - RNA, 21 nt, Artificial Sequence
  Synthetic construct
aaagucugccucuugcgcugu

SEQ ID NO: 6243 - RNA, 21 nt, Artificial Sequence
  Synthetic construct
ucagauggaaccugcugcuug

SEQ ID NO: 6244 - RNA, 21 nt, Artificial Sequence
  Synthetic construct
aaccguucaccacucuucuga

SEQ ID NO: 6245 - RNA, 21 nt, Artificial Sequence
  Synthetic construct
uuuccuccaauaguuccuuuu

SEQ ID NO: 6246 - RNA, 21 nt, Artificial Sequence
  Synthetic construct
ugcaccacuguucccgcuguu

SEQ ID NO: 6247 - RNA, 21 nt, Artificial Sequence
  Synthetic construct
aauguucacugcaccacuguu

SEQ ID NO: 6248 - RNA, 21 nt, Artificial Sequence
  Synthetic construct
ugcaggaacggccucggccug

SEQ ID NO: 6249 - RNA, 21 nt, Artificial Sequence
  Synthetic construct
aauuuagcuuuaaccuccuga

SEQ ID NO: 6250 - RNA, 21 nt, Artificial Sequence
  Synthetic construct
cuuacucacaccuagucgccg

SEQ ID NO: 6251 - RNA, 21 nt, Artificial Sequence
  Synthetic construct
cuauguuccuugaugaacgag

SEQ ID NO: 6252 - RNA, 21 nt, Artificial Sequence
  Synthetic construct
uuguugguuugguugcugauu

SEQ ID NO: 6253 - RNA, 21 nt, Artificial Sequence
  Synthetic construct
aguuucacuagcaccauguug

SEQ ID NO: 6254 - RNA, 21 nt, Artificial Sequence
  Synthetic construct
ucgucaucggacagcaagccc

SEQ ID NO: 6255 - RNA, 21 nt, Artificial Sequence
  Synthetic construct
uucuaacuucuuguccacauc

SEQ ID NO: 6256 - RNA, 21 nt, Artificial Sequence
  Synthetic construct
ucugcuuugaccgguucugcu

SEQ ID NO: 6257 - RNA, 21 nt, Artificial Sequence
  Synthetic construct
ugauuggagagacucaccaag

SEQ ID NO: 6258 - RNA, 21 nt, Artificial Sequence
  Synthetic construct
ucagugguagaguuuagcucu

SEQ ID NO: 6259 - RNA, 21 nt, Artificial Sequence
  Synthetic construct
ucaauaucaucaucaaggccu

SEQ ID NO: 6260 - RNA, 21 nt, Artificial Sequence
  Synthetic construct
cucaauacggacacaacccug

SEQ ID NO: 6261 - RNA, 21 nt, Artificial Sequence
  Synthetic construct
ugaguuagugacuccauaugu

SEQ ID NO: 6262 - RNA, 21 nt, Artificial Sequence
  Synthetic construct
uggaguucugguugagguggg

SEQ ID NO: 6263 - RNA, 21 nt, Artificial Sequence
  Synthetic construct
acaacuuguaggagcuccucu

SEQ ID NO: 6264 - RNA, 21 nt, Artificial Sequence
  Synthetic construct
uacuguccucagauggaaccu

SEQ ID NO: 6265 - RNA, 21 nt, Artificial Sequence
  Synthetic construct
aaaucugcagcuguggacuca

SEQ ID NO: 6266 - RNA, 21 nt, Artificial Sequence
  Synthetic construct
cuucuuguccacaucaauggu

SEQ ID NO: 6267 - RNA, 21 nt, Artificial Sequence
  Synthetic construct
ugcuuguccucuagggaggua

SEQ ID NO: 6268 - RNA, 21 nt, Artificial Sequence
  Synthetic construct
ucuaauaggucauaaagcagu

SEQ ID NO: 6269 - RNA, 21 nt, Artificial Sequence
  Synthetic construct
ugcauagaaaucauauaagua

SEQ ID NO: 6270 - RNA, 21 nt, Artificial Sequence
  Synthetic construct
aguuucugaagcucuguccgc

SEQ ID NO: 6271 - RNA, 21 nt, Artificial Sequence
  Synthetic construct
acagagugacagcucgcugau

SEQ ID NO: 6272 - RNA, 21 nt, Artificial Sequence
  Synthetic construct
ugauacugcucagcaauacau

SEQ ID NO: 6273 - RNA, 21 nt, Artificial Sequence
  Synthetic construct
acacucgagucaacuugcugu

SEQ ID NO: 6274 - RNA, 21 nt, Artificial Sequence
  Synthetic construct
ugauacuuaugcaacucuuca

SEQ ID NO: 6275 - RNA, 21 nt, Artificial Sequence
  Synthetic construct
caaccguucaccacucuucug

SEQ ID NO: 6276 - RNA, 21 nt, Artificial Sequence
  Synthetic construct
uccuugaggauauuuaguuuu

SEQ ID NO: 6277 - RNA, 21 nt, Artificial Sequence
  Synthetic construct
uucuagcucuucaaucuuuuc

SEQ ID NO: 6278 - RNA, 21 nt, Artificial Sequence
  Synthetic construct
gugucugaguauugcauccug

SEQ ID NO: 6279 - RNA, 21 nt, Artificial Sequence
  Synthetic construct
acuuaugcaacucuucagugg

SEQ ID NO: 6280 - RNA, 21 nt, Artificial Sequence
  Synthetic construct
cuuccugucguuccaacucug

SEQ ID NO: 6281 - RNA, 21 nt, Artificial Sequence
  Synthetic construct
acuuguaggagcuccucuuug

SEQ ID NO: 6282 - RNA, 21 nt, Artificial Sequence
  Synthetic construct
uauccgacuuucgauguagac

SEQ ID NO: 6283 - RNA, 21 nt, Artificial Sequence
  Synthetic construct
aaacuacgacaucgucaucgg

SEQ ID NO: 6284 - RNA, 21 nt, Artificial Sequence
  Synthetic construct
acugcucagcaauacaugcug

SEQ ID NO: 6285 - RNA, 21 nt, Artificial Sequence
  Synthetic construct
auucagacccugauugcugau

SEQ ID NO: 6286 - RNA, 21 nt, Artificial Sequence
  Synthetic construct
uguaauuuagcuuuaaccucc

SEQ ID NO: 6287 - RNA, 21 nt, Artificial Sequence
  Synthetic construct
uccuguuugauuaagauguca

SEQ ID NO: 6288 - RNA, 21 nt, Artificial Sequence
  Synthetic construct
ucgcauagccgcaaagucugc

SEQ ID NO: 6289 - RNA, 21 nt, Artificial Sequence
  Synthetic construct
ugggugcuuguagaacaaggg

SEQ ID NO: 6290 - RNA, 21 nt, Artificial Sequence
  Synthetic construct
aacucuucagugguagaguuu

SEQ ID NO: 6291 - RNA, 21 nt, Artificial Sequence
  Synthetic construct
auuggagagacucaccaaguu

SEQ ID NO: 6292 - RNA, 21 nt, Artificial Sequence
  Synthetic construct
auuuccuccaauaguuccuuu

SEQ ID NO: 6293 - RNA, 21 nt, Artificial Sequence
  Synthetic construct
uucugcuuugaccgguucugc

SEQ ID NO: 6294 - RNA, 21 nt, Artificial Sequence
  Synthetic construct
uccaacucugaagguaacaag

SEQ ID NO: 6295 - RNA, 21 nt, Artificial Sequence
  Synthetic construct
ugacugcucuucucuuucccc

SEQ ID NO: 6296 - RNA, 21 nt, Artificial Sequence
  Synthetic construct
uuuccuccugucggaucugcu

SEQ ID NO: 6297 - RNA, 21 nt, Artificial Sequence
  Synthetic construct
gacacaacccugaucuuccug

SEQ ID NO: 6298 - RNA, 21 nt, Artificial Sequence
  Synthetic construct
uugcaaauuucaucucggaga

SEQ ID NO: 6299 - RNA, 21 nt, Artificial Sequence
  Synthetic construct
auguagacacuccucuucaag

SEQ ID NO: 6300 - RNA, 21 nt, Artificial Sequence
  Synthetic construct
aagggaaccagguucugcuuu

SEQ ID NO: 6301 - RNA, 21 nt, Artificial Sequence
  Synthetic construct
uucauugcucuucagggcaaa

SEQ ID NO: 6302 - RNA, 21 nt, Artificial Sequence
  Synthetic construct
aagucugccucuugcgcuguu

SEQ ID NO: 6303 - RNA, 21 nt, Artificial Sequence
  Synthetic construct
aaucccaguugcauagguggg

SEQ ID NO: 6304 - RNA, 21 nt, Artificial Sequence
  Synthetic construct
acuauguuccuugaugaacga

SEQ ID NO: 6305 - RNA, 21 nt, Artificial Sequence
  Synthetic construct
acaguuagguugaagaaggau

SEQ ID NO: 6306 - RNA, 21 nt, Artificial Sequence
  Synthetic construct
uuccugcaagagagcuucuag

SEQ ID NO: 6307 - RNA, 21 nt, Artificial Sequence
  Synthetic construct
uguaggauccugauugagaag

SEQ ID NO: 6308 - RNA, 21 nt, Artificial Sequence
  Synthetic construct
uuccaacucugaagguaacaa

SEQ ID NO: 6309 - RNA, 21 nt, Artificial Sequence
  Synthetic construct
uaggauccugauugagaagau

SEQ ID NO: 6310 - RNA, 21 nt, Artificial Sequence
  Synthetic construct
aucagguguuggaugaaguug

SEQ ID NO: 6311 - RNA, 21 nt, Artificial Sequence
  Synthetic construct
aacacaguaugauacugcuca

SEQ ID NO: 6312 - RNA, 21 nt, Artificial Sequence
  Synthetic construct
uccuugaugaacgagugcagg

SEQ ID NO: 6313 - RNA, 21 nt, Artificial Sequence
  Synthetic construct
uagaucucaaagaaugagauc

SEQ ID NO: 6314 - RNA, 21 nt, Artificial Sequence
  Synthetic construct
acuguccucagauggaaccug

SEQ ID NO: 6315 - RNA, 21 nt, Artificial Sequence
  Synthetic construct
accuuggaacacucgagucaa

SEQ ID NO: 6316 - RNA, 21 nt, Artificial Sequence
  Synthetic construct
aaccuccugaagcugcugggu

SEQ ID NO: 6317 - RNA, 21 nt, Artificial Sequence
  Synthetic construct
ucugguucuuacgacccacuu

SEQ ID NO: 6318 - RNA, 21 nt, Artificial Sequence
  Synthetic construct
ucaauacggacacaacccuga

SEQ ID NO: 6319 - RNA, 21 nt, Artificial Sequence
  Synthetic construct
uaccuugaaucguguggguuu

SEQ ID NO: 6320 - RNA, 21 nt, Artificial Sequence
  Synthetic construct
gauacuuaugcaacucuucag

SEQ ID NO: 6321 - RNA, 21 nt, Artificial Sequence
  Synthetic construct
uagugucugaguauugcaucc

SEQ ID NO: 6322 - RNA, 21 nt, Artificial Sequence
  Synthetic construct
ucguuguagaucucaaagaau

SEQ ID NO: 6323 - RNA, 21 nt, Artificial Sequence
  Synthetic construct
aaccugcugcuuguccucuag

SEQ ID NO: 6324 - RNA, 21 nt, Artificial Sequence
  Synthetic construct
aucccaguugcauaggugggg

SEQ ID NO: 6325 - RNA, 21 nt, Artificial Sequence
  Synthetic construct
agagcagucugauagcagguu

SEQ ID NO: 6326 - RNA, 21 nt, Artificial Sequence
  Synthetic construct
uguagagagguguuaauguuu

SEQ ID NO: 6327 - RNA, 21 nt, Artificial Sequence
  Synthetic construct
ucuccacauucucaauacgga

SEQ ID NO: 6328 - RNA, 21 nt, Artificial Sequence
  Synthetic construct
ucccugaguuagugacuccau

SEQ ID NO: 6329 - RNA, 21 nt, Artificial Sequence
  Synthetic construct
aucacaaguggucaaggcuug

SEQ ID NO: 6330 - RNA, 21 nt, Artificial Sequence
  Synthetic construct
acuuucaccuucuccauacug

SEQ ID NO: 6331 - RNA, 21 nt, Artificial Sequence
  Synthetic construct
cuuugcagcgcucugagccag

SEQ ID NO: 6332 - RNA, 21 nt, Artificial Sequence
  Synthetic construct
aagaugcugugacugcggcug

SEQ ID NO: 6333 - RNA, 21 nt, Artificial Sequence
  Synthetic construct
augguaccuugaaucgugugg

SEQ ID NO: 6334 - RNA, 21 nt, Artificial Sequence
  Synthetic construct
caacacaguaugauacugcuc

SEQ ID NO: 6335 - RNA, 21 nt, Artificial Sequence
  Synthetic construct
auccuuuaccaucuccuucac

SEQ ID NO: 6336 - RNA, 21 nt, Artificial Sequence
  Synthetic construct
ucuucauacauuuccuccaau

SEQ ID NO: 6337 - RNA, 21 nt, Artificial Sequence
  Synthetic construct
uucaaggaaguggacagcucc

SEQ ID NO: 6338 - RNA, 21 nt, Artificial Sequence
  Synthetic construct
uaccuauccgacuuucgaugu

SEQ ID NO: 6339 - RNA, 21 nt, Artificial Sequence
  Synthetic construct
cugcccuuugaguacauccuu

SEQ ID NO: 6340 - RNA, 21 nt, Artificial Sequence
  Synthetic construct
uugagaagaugcugugacugc

SEQ ID NO: 6341 - RNA, 21 nt, Artificial Sequence
  Synthetic construct
ucaaagaaugagauccagaug

SEQ ID NO: 6342 - RNA, 21 nt, Artificial Sequence
  Synthetic construct
uugguuugguugcugauuuuc

SEQ ID NO: 6343 - RNA, 21 nt, Artificial Sequence
  Synthetic construct
auagccgcaaagucugccucu

SEQ ID NO: 6344 - RNA, 21 nt, Artificial Sequence
  Synthetic construct
ugcaaauuucaucucggagau

SEQ ID NO: 6345 - RNA, 21 nt, Artificial Sequence
  Synthetic construct
ucaggagaguagcugacccac

SEQ ID NO: 6346 - RNA, 21 nt, Artificial Sequence
  Synthetic construct
uguagaacaagggucuccaca

SEQ ID NO: 6347 - RNA, 21 nt, Artificial Sequence
  Synthetic construct
cugauuggagagacucaccaa

SEQ ID NO: 6348 - RNA, 21 nt, Artificial Sequence
  Synthetic construct
ucuuucacauagggauugcca

SEQ ID NO: 6349 - RNA, 21 nt, Artificial Sequence
  Synthetic construct
ucaaguauacuuucaccuucu

SEQ ID NO: 6350 - RNA, 21 nt, Artificial Sequence
  Synthetic construct
auuuagcuuuaaccuccugaa

SEQ ID NO: 6351 - RNA, 21 nt, Artificial Sequence
  Synthetic construct
aucccuugcgacaugacggca

SEQ ID NO: 6352 - RNA, 21 nt, Artificial Sequence
  Synthetic construct
ugcugguacacugacugauag

SEQ ID NO: 6353 - RNA, 21 nt, Artificial Sequence
  Synthetic construct
aauccaguugagaucuuucac

SEQ ID NO: 6354 - RNA, 21 nt, Artificial Sequence
  Synthetic construct
cugaagacuauguuccuugau

SEQ ID NO: 6355 - RNA, 21 nt, Artificial Sequence
  Synthetic construct
agcaguucguuguagaucuca

SEQ ID NO: 6356 - RNA, 21 nt, Artificial Sequence
  Synthetic construct
uugggugcuuguagaacaagg

SEQ ID NO: 6357 - RNA, 21 nt, Artificial Sequence
  Synthetic construct
uacauuuggaauucaauaaaa

SEQ ID NO: 6358 - RNA, 21 nt, Artificial Sequence
  Synthetic construct
uccugaaucucuucuugguaa

SEQ ID NO: 6359 - RNA, 21 nt, Artificial Sequence
  Synthetic construct
ugaacgagugcagggauggga

SEQ ID NO: 6360 - RNA, 21 nt, Artificial Sequence
  Synthetic construct
ugcauccuggauauaauuccu

SEQ ID NO: 6361 - RNA, 21 nt, Artificial Sequence
  Synthetic construct
auuucgaaggaaugguuucuu

SEQ ID NO: 6362 - RNA, 21 nt, Artificial Sequence
  Synthetic construct
uguuaauguuuccugcuuccu

SEQ ID NO: 6363 - RNA, 21 nt, Artificial Sequence
  Synthetic construct
acucuucugaucuuugcagcg

SEQ ID NO: 6364 - RNA, 21 nt, Artificial Sequence
  Synthetic construct
uguuccuugaugaacgagugc

SEQ ID NO: 6365 - RNA, 21 nt, Artificial Sequence
  Synthetic construct
cuguaauuuagcuuuaaccuc

SEQ ID NO: 6366 - RNA, 21 nt, Artificial Sequence
  Synthetic construct
gaacacucgagucaacuugcu

SEQ ID NO: 6367 - RNA, 21 nt, Artificial Sequence
  Synthetic construct
ugguaccuauccgacuuucga

SEQ ID NO: 6368 - RNA, 21 nt, Artificial Sequence
  Synthetic construct
ucaaccguucaccacucuucu

SEQ ID NO: 6369 - RNA, 21 nt, Artificial Sequence
  Synthetic construct
uccacaucaauggugaagggc

SEQ ID NO: 6370 - RNA, 21 nt, Artificial Sequence
  Synthetic construct
ucgagucaacuugcugucacg

SEQ ID NO: 6371 - RNA, 21 nt, Artificial Sequence
  Synthetic construct
uucucaauacggacacaaccc

SEQ ID NO: 6372 - RNA, 21 nt, Artificial Sequence
  Synthetic construct
acagcuucuucauuuccuccu

SEQ ID NO: 6373 - RNA, 21 nt, Artificial Sequence
  Synthetic construct
caacuuguaggagcuccucuu

SEQ ID NO: 6374 - RNA, 21 nt, Artificial Sequence
  Synthetic construct
ugaagcugcuggguggaggca

SEQ ID NO: 6375 - RNA, 21 nt, Artificial Sequence
  Synthetic construct
ugggagaaacuacgacaucgu

SEQ ID NO: 6376 - RNA, 21 nt, Artificial Sequence
  Synthetic construct
uaggugguuauaauacaaaag

SEQ ID NO: 6377 - RNA, 21 nt, Artificial Sequence
  Synthetic construct
gacagcucgcugaucuugggg

SEQ ID NO: 6378 - RNA, 21 nt, Artificial Sequence
  Synthetic construct
accaaguuucugaagcucugu

SEQ ID NO: 6379 - RNA, 21 nt, Artificial Sequence
  Synthetic construct
uaaagcaguucguuguagauc

SEQ ID NO: 6380 - RNA, 21 nt, Artificial Sequence
  Synthetic construct
acuugucagugacuccuugag

SEQ ID NO: 6381 - RNA, 21 nt, Artificial Sequence
  Synthetic construct
uucaccuucuccauacugucc

SEQ ID NO: 6382 - RNA, 21 nt, Artificial Sequence
  Synthetic construct
guauacuuucaccuucuccau

SEQ ID NO: 6383 - RNA, 21 nt, Artificial Sequence
  Synthetic construct
cagugguagaguuuagcucug

SEQ ID NO: 6384 - RNA, 21 nt, Artificial Sequence
  Synthetic construct
uccaaauguucacugcaccac

SEQ ID NO: 6385 - RNA, 21 nt, Artificial Sequence
  Synthetic construct
augguuucuucccuggugguu

SEQ ID NO: 6386 - RNA, 21 nt, Artificial Sequence
  Synthetic construct
agagacgacagagcagucuga

SEQ ID NO: 6387 - RNA, 21 nt, Artificial Sequence
  Synthetic construct
ugugaagaaaccuuggaacac

SEQ ID NO: 6388 - RNA, 21 nt, Artificial Sequence
  Synthetic construct
uucaaccguucaccacucuuc

SEQ ID NO: 6389 - RNA, 21 nt, Artificial Sequence
  Synthetic construct
ugcacagggauucacauugac

SEQ ID NO: 6390 - RNA, 21 nt, Artificial Sequence
  Synthetic construct
ugacaaucaugcaggaacggc

SEQ ID NO: 6391 - RNA, 21 nt, Artificial Sequence
  Synthetic construct
auacauggagaugucagcuuc

SEQ ID NO: 6392 - RNA, 21 nt, Artificial Sequence
  Synthetic construct
auaaagcaguucguuguagau

SEQ ID NO: 6393 - RNA, 21 nt, Artificial Sequence
  Synthetic construct
caugagauuacauaggugguu

SEQ ID NO: 6394 - RNA, 21 nt, Artificial Sequence
  Synthetic construct
cucuucuaacuucuuguccac

SEQ ID NO: 6395 - RNA, 21 nt, Artificial Sequence
  Synthetic construct
cacaccuagucgccgaagcug

SEQ ID NO: 6396 - RNA, 21 nt, Artificial Sequence
  Synthetic construct
gacaucgucaucggacagcaa

SEQ ID NO: 6397 - RNA, 21 nt, Artificial Sequence
  Synthetic construct
acuagcaccauguuguucugc

SEQ ID NO: 6398 - RNA, 21 nt, Artificial Sequence
  Synthetic construct
uagcugacccaccucagggcc

SEQ ID NO: 6399 - RNA, 21 nt, Artificial Sequence
  Synthetic construct
acucgagucaacuugcuguca

SEQ ID NO: 6400 - RNA, 21 nt, Artificial Sequence
  Synthetic construct
aagggcuucagaucagguguu

SEQ ID NO: 6401 - RNA, 21 nt, Artificial Sequence
  Synthetic construct
aaccagguucugcuuugaccg

SEQ ID NO: 6402 - RNA, 21 nt, Artificial Sequence
  Synthetic construct
ugaacaauaauaucuuuaaua

SEQ ID NO: 6403 - RNA, 21 nt, Artificial Sequence
  Synthetic construct
uucaucauagguagaugcaca

SEQ ID NO: 6404 - RNA, 21 nt, Artificial Sequence
  Synthetic construct
ugaggguggugguucuaacau

SEQ ID NO: 6405 - RNA, 21 nt, Artificial Sequence
  Synthetic construct
ucagaucagguguuggaugaa

SEQ ID NO: 6406 - RNA, 21 nt, Artificial Sequence
  Synthetic construct
uuccuccaauaguuccuuuug

SEQ ID NO: 6407 - RNA, 21 nt, Artificial Sequence
  Synthetic construct
agcuucuucauuuccuccugu

SEQ ID NO: 6408 - RNA, 21 nt, Artificial Sequence
  Synthetic construct
acaucgucaucggacagcaag

SEQ ID NO: 6409 - RNA, 21 nt, Artificial Sequence
  Synthetic construct
agagagcuucuagcucuucaa

SEQ ID NO: 6410 - RNA, 21 nt, Artificial Sequence
  Synthetic construct
cauugcaaauuucaucucgga

SEQ ID NO: 6411 - RNA, 21 nt, Artificial Sequence
  Synthetic construct
aagaguuucaucauagguaga

SEQ ID NO: 6412 - RNA, 21 nt, Artificial Sequence
  Synthetic construct
aagcuggacuuucgcagccgc

SEQ ID NO: 6413 - RNA, 21 nt, Artificial Sequence
  Synthetic construct
aucgucaucggacagcaagcc

SEQ ID NO: 6414 - RNA, 21 nt, Artificial Sequence
  Synthetic construct
uuucgaaggaaugguuucuuc

SEQ ID NO: 6415 - RNA, 21 nt, Artificial Sequence
  Synthetic construct
uccuuuaccaucuccuucaca

SEQ ID NO: 6416 - RNA, 21 nt, Artificial Sequence
  Synthetic construct
cagcuucuucauuuccuccug

SEQ ID NO: 6417 - RNA, 21 nt, Artificial Sequence
  Synthetic construct
caacucugaagguaacaaggg

SEQ ID NO: 6418 - RNA, 21 nt, Artificial Sequence
  Synthetic construct
uggguguccaaauguucacug

SEQ ID NO: 6419 - RNA, 21 nt, Artificial Sequence
  Synthetic construct
uaggauccgggcauaagggcu

SEQ ID NO: 6420 - RNA, 21 nt, Artificial Sequence
  Synthetic construct
acaugagauuacauagguggu

SEQ ID NO: 6421 - RNA, 21 nt, Artificial Sequence
  Synthetic construct
accacucuucugaucuuugca

SEQ ID NO: 6422 - RNA, 21 nt, Artificial Sequence
  Synthetic construct
uaccaucucauugcaaauuuc

SEQ ID NO: 6423 - RNA, 21 nt, Artificial Sequence
  Synthetic construct
acauccuuuaccaucuccuuc

SEQ ID NO: 6424 - RNA, 21 nt, Artificial Sequence
  Synthetic construct
ugaagaaaccuuggaacacuc

SEQ ID NO: 6425 - RNA, 21 nt, Artificial Sequence
  Synthetic construct
ucuuguccacaucaaugguga

SEQ ID NO: 6426 - RNA, 21 nt, Artificial Sequence
  Synthetic construct
uagugacuccauauguauaga

SEQ ID NO: 6427 - RNA, 21 nt, Artificial Sequence
  Synthetic construct
ucaucacaaguggucaaggcu

SEQ ID NO: 6428 - RNA, 21 nt, Artificial Sequence
  Synthetic construct
cacaacuuguaggagcuccuc

SEQ ID NO: 6429 - RNA, 21 nt, Artificial Sequence
  Synthetic construct
aagaugucaucacaagugguc

SEQ ID NO: 6430 - RNA, 21 nt, Artificial Sequence
  Synthetic construct
aaucugcagcuguggacucaa

SEQ ID NO: 6431 - RNA, 21 nt, Artificial Sequence
  Synthetic construct
uccauccuugaugguaccuug

SEQ ID NO: 6432 - RNA, 21 nt, Artificial Sequence
  Synthetic construct
uggagaagcgaauguuugccg

SEQ ID NO: 6433 - RNA, 21 nt, Artificial Sequence
  Synthetic construct
uacauuuccuccaauaguucc

SEQ ID NO: 6434 - RNA, 21 nt, Artificial Sequence
  Synthetic construct
ucgaagcuggugcugguaccu

SEQ ID NO: 6435 - RNA, 21 nt, Artificial Sequence
  Synthetic construct
augaacgagugcagggauggg

SEQ ID NO: 6436 - RNA, 21 nt, Artificial Sequence
  Synthetic construct
agcuguggacucaaacauggg

SEQ ID NO: 6437 - RNA, 21 nt, Artificial Sequence
  Synthetic construct
ucugcugauuggagagacuca

SEQ ID NO: 6438 - RNA, 21 nt, Artificial Sequence
  Synthetic construct
accuuugugaccgccguaggg

SEQ ID NO: 6439 - RNA, 21 nt, Artificial Sequence
  Synthetic construct
cacauugacaaucaugcagga

SEQ ID NO: 6440 - RNA, 21 nt, Artificial Sequence
  Synthetic construct
caguaugauacugcucagcaa

SEQ ID NO: 6441 - RNA, 21 nt, Artificial Sequence
  Synthetic construct
ugaccgguucugcugguuuug

SEQ ID NO: 6442 - RNA, 21 nt, Artificial Sequence
  Synthetic construct
ugagauuacauaggugguuau

SEQ ID NO: 6443 - RNA, 21 nt, Artificial Sequence
  Synthetic construct
aaagaaugagauccagaugga

SEQ ID NO: 6444 - RNA, 21 nt, Artificial Sequence
  Synthetic construct
auguuccuugaugaacgagug

SEQ ID NO: 6445 - RNA, 21 nt, Artificial Sequence
  Synthetic construct
ucuccuucacaguuagguuga

SEQ ID NO: 6446 - RNA, 21 nt, Artificial Sequence
  Synthetic construct
ucucucugcugauuggagaga

SEQ ID NO: 6447 - RNA, 21 nt, Artificial Sequence
  Synthetic construct
ucacaaguggucaaggcuuga

SEQ ID NO: 6448 - RNA, 21 nt, Artificial Sequence
  Synthetic construct
cuguugcaucuguucuaccau

SEQ ID NO: 6449 - RNA, 21 nt, Artificial Sequence
  Synthetic construct
uuucaucucggagaugcaucu

SEQ ID NO: 6450 - RNA, 21 nt, Artificial Sequence
  Synthetic construct
uauugcauccuggauauaauu

SEQ ID NO: 6451 - RNA, 21 nt, Artificial Sequence
  Synthetic construct
cugcuuugaccgguucugcug

SEQ ID NO: 6452 - RNA, 21 nt, Artificial Sequence
  Synthetic construct
agcucugguucuuacgaccca

SEQ ID NO: 6453 - RNA, 21 nt, Artificial Sequence
  Synthetic construct
aaguauacuuucaccuucucc

SEQ ID NO: 6454 - RNA, 21 nt, Artificial Sequence
  Synthetic construct
acacugacugauagaagagag

SEQ ID NO: 6455 - RNA, 21 nt, Artificial Sequence
  Synthetic construct
acauaggugguuauaauacaa

SEQ ID NO: 6456 - RNA, 21 nt, Artificial Sequence
  Synthetic construct
gcaucuugcacaugaauccag

SEQ ID NO: 6457 - RNA, 21 nt, Artificial Sequence
  Synthetic construct
ucugcccuuugaguacauccu

SEQ ID NO: 6458 - RNA, 21 nt, Artificial Sequence
  Synthetic construct
uuggagagcaagggcuucaga

SEQ ID NO: 6459 - RNA, 21 nt, Artificial Sequence
  Synthetic construct
agguguuaauguuuccugcuu

SEQ ID NO: 6460 - RNA, 21 nt, Artificial Sequence
  Synthetic construct
cuccugaaucucuucuuggua

SEQ ID NO: 6461 - RNA, 21 nt, Artificial Sequence
  Synthetic construct
ugaagcucuguccgcaacagc

SEQ ID NO: 6462 - RNA, 21 nt, Artificial Sequence
  Synthetic construct
uccugauugagaagaugcugu

SEQ ID NO: 6463 - RNA, 21 nt, Artificial Sequence
  Synthetic construct
uucugaagcucuguccgcaac

SEQ ID NO: 6464 - RNA, 21 nt, Artificial Sequence
  Synthetic construct
auggaaccugcugcuuguccu

SEQ ID NO: 6465 - RNA, 21 nt, Artificial Sequence
  Synthetic construct
aggaaguggacagcuccuccu

SEQ ID NO: 6466 - RNA, 21 nt, Artificial Sequence
  Synthetic construct
cugaucuuugcagcgcucuga

SEQ ID NO: 6467 - RNA, 21 nt, Artificial Sequence
  Synthetic construct
uaugauacugcucagcaauac

SEQ ID NO: 6468 - RNA, 21 nt, Artificial Sequence
  Synthetic construct
cauagguagaugcacagggau

SEQ ID NO: 6469 - RNA, 21 nt, Artificial Sequence
  Synthetic construct
accuauccgacuuucgaugua

SEQ ID NO: 6470 - RNA, 21 nt, Artificial Sequence
  Synthetic construct
aagguguaggauccugauuga

SEQ ID NO: 6471 - RNA, 21 nt, Artificial Sequence
  Synthetic construct
uguccucagauggaaccugcu

SEQ ID NO: 6472 - RNA, 21 nt, Artificial Sequence
  Synthetic construct
auaucaucaucaaggccugug

SEQ ID NO: 6473 - RNA, 21 nt, Artificial Sequence
  Synthetic construct
ucuucaaggaaguggacagcu

SEQ ID NO: 6474 - RNA, 21 nt, Artificial Sequence
  Synthetic construct
uguuugauuaagaugucauca

SEQ ID NO: 6475 - RNA, 21 nt, Artificial Sequence
  Synthetic construct
ugauuaagaugucaucacaag

SEQ ID NO: 6476 - RNA, 21 nt, Artificial Sequence
  Synthetic construct
ucugguugaggugggugcugg

SEQ ID NO: 6477 - RNA, 21 nt, Artificial Sequence
  Synthetic construct
uuugaccgguucugcugguuu

SEQ ID NO: 6478 - RNA, 21 nt, Artificial Sequence
  Synthetic construct
uaauuccugauauaugguaaa

SEQ ID NO: 6479 - RNA, 21 nt, Artificial Sequence
  Synthetic construct
ugacuccuugaggauauuuag

SEQ ID NO: 6480 - RNA, 21 nt, Artificial Sequence
  Synthetic construct
agcuagugucugaguauugca

SEQ ID NO: 6481 - RNA, 21 nt, Artificial Sequence
  Synthetic construct
ucgccgaagcuggacuuucgc

SEQ ID NO: 6482 - RNA, 21 nt, Artificial Sequence
  Synthetic construct
ucacaccuagucgccgaagcu

SEQ ID NO: 6483 - RNA, 21 nt, Artificial Sequence
  Synthetic construct
cuuucgauguagacacuccuc

SEQ ID NO: 6484 - RNA, 21 nt, Artificial Sequence
  Synthetic construct
uguugcaucuguucuaccauc

SEQ ID NO: 6485 - RNA, 21 nt, Artificial Sequence
  Synthetic construct
ucccuugcgacaugacggcag

SEQ ID NO: 6486 - RNA, 21 nt, Artificial Sequence
  Synthetic construct
ugucacggaagggaaccaggu

SEQ ID NO: 6487 - RNA, 21 nt, Artificial Sequence
  Synthetic construct
acauggagaugucagcuucau

SEQ ID NO: 6488 - RNA, 21 nt, Artificial Sequence
  Synthetic construct
acugcuguaauuuagcuuuaa

SEQ ID NO: 6489 - RNA, 21 nt, Artificial Sequence
  Synthetic construct
aaugguuucuucccugguggu

SEQ ID NO: 6490 - RNA, 21 nt, Artificial Sequence
  Synthetic construct
acaacaacaugagauuacaua

SEQ ID NO: 6491 - RNA, 21 nt, Artificial Sequence
  Synthetic construct
ucaugcaggaacggccucggc

SEQ ID NO: 6492 - RNA, 21 nt, Artificial Sequence
  Synthetic construct
uugcuccuccugggauacugg

SEQ ID NO: 6493 - RNA, 21 nt, Artificial Sequence
  Synthetic construct
uggugcugguaccuauccgac

SEQ ID NO: 6494 - RNA, 21 nt, Artificial Sequence
  Synthetic construct
ugugaacaauaauaucuuuaa

SEQ ID NO: 6495 - RNA, 21 nt, Artificial Sequence
  Synthetic construct
accuucuccauacuguccuca

SEQ ID NO: 6496 - RNA, 21 nt, Artificial Sequence
  Synthetic construct
acuucuuguccacaucaaugg

SEQ ID NO: 6497 - RNA, 21 nt, Artificial Sequence
  Synthetic construct
ugcacaugaauccaguugaga

SEQ ID NO: 6498 - RNA, 21 nt, Artificial Sequence
  Synthetic construct
uaggagcuuccaggccuccuc

SEQ ID NO: 6499 - RNA, 21 nt, Artificial Sequence
  Synthetic construct
cuuccugcaagagagcuucua

SEQ ID NO: 6500 - RNA, 21 nt, Artificial Sequence
  Synthetic construct
ucuucccuggugguuguuggu

SEQ ID NO: 6501 - RNA, 21 nt, Artificial Sequence
  Synthetic construct
auaauuccugauauaugguaa

SEQ ID NO: 6502 - RNA, 21 nt, Artificial Sequence
  Synthetic construct
guaccuugaaucguguggguu

SEQ ID NO: 6503 - RNA, 21 nt, Artificial Sequence
  Synthetic construct
augucaucacaaguggucaag

SEQ ID NO: 6504 - RNA, 21 nt, Artificial Sequence
  Synthetic construct
acagcucgcugaucuugggga

SEQ ID NO: 6505 - RNA, 21 nt, Artificial Sequence
  Synthetic construct
uacauaggugguuauaauaca

SEQ ID NO: 6506 - RNA, 21 nt, Artificial Sequence
  Synthetic construct
ugauauaugguaaagcauaaa

SEQ ID NO: 6507 - RNA, 21 nt, Artificial Sequence
  Synthetic construct
agaguagcugacccaccucag

SEQ ID NO: 6508 - RNA, 21 nt, Artificial Sequence
  Synthetic construct
ucauuggagagcaagggcuuc

SEQ ID NO: 6509 - RNA, 21 nt, Artificial Sequence
  Synthetic construct
uggagaugucagcuucauuuu

SEQ ID NO: 6510 - RNA, 21 nt, Artificial Sequence
  Synthetic construct
ugacuccauauguauagauga

SEQ ID NO: 6511 - RNA, 21 nt, Artificial Sequence
  Synthetic construct
cugauagcagguucuugcgua

SEQ ID NO: 6512 - RNA, 21 nt, Artificial Sequence
  Synthetic construct
auaagggcugcagucuguuga

SEQ ID NO: 6513 - RNA, 21 nt, Artificial Sequence
  Synthetic construct
agaucuuucacauagggauug

SEQ ID NO: 6514 - RNA, 21 nt, Artificial Sequence
  Synthetic construct
ugauugagaagaugcugugac

SEQ ID NO: 6515 - RNA, 21 nt, Artificial Sequence
  Synthetic construct
uguuugccgggacagguagug

SEQ ID NO: 6516 - RNA, 21 nt, Artificial Sequence
  Synthetic construct
ucaacuugcugucacggaagg

SEQ ID NO: 6517 - RNA, 21 nt, Artificial Sequence
  Synthetic construct
agcucugcuuugcacugcugu

SEQ ID NO: 6518 - RNA, 21 nt, Artificial Sequence
  Synthetic construct
uagaaaucauauaaguaaaua

SEQ ID NO: 6519 - RNA, 21 nt, Artificial Sequence
  Synthetic construct
acauucucaauacggacacaa

SEQ ID NO: 6520 - RNA, 21 nt, Artificial Sequence
  Synthetic construct
augcacagggauucacauuga

SEQ ID NO: 6521 - RNA, 21 nt, Artificial Sequence
  Synthetic construct
guccaguuucacuagcaccau

SEQ ID NO: 6522 - RNA, 21 nt, Artificial Sequence
  Synthetic construct
cucauugcaaauuucaucucg

SEQ ID NO: 6523 - RNA, 21 nt, Artificial Sequence
  Synthetic construct
guugagaucuuucacauaggg

SEQ ID NO: 6524 - RNA, 21 nt, Artificial Sequence
  Synthetic construct
cagucugauagcagguucuug

SEQ ID NO: 6525 - RNA, 21 nt, Artificial Sequence
  Synthetic construct
agucaacuugcugucacggaa

SEQ ID NO: 6526 - RNA, 21 nt, Artificial Sequence
  Synthetic construct
uuucuucccuggugguuguug

SEQ ID NO: 6527 - RNA, 21 nt, Artificial Sequence
  Synthetic construct
acaccuagucgccgaagcugg

SEQ ID NO: 6528 - RNA, 21 nt, Artificial Sequence
  Synthetic construct
auacauuuccuccaauaguuc

SEQ ID NO: 6529 - RNA, 21 nt, Artificial Sequence
  Synthetic construct
auccaguugagaucuuucaca

SEQ ID NO: 6530 - RNA, 21 nt, Artificial Sequence
  Synthetic construct
gaugguaccuugaaucgugug

SEQ ID NO: 6531 - RNA, 21 nt, Artificial Sequence
  Synthetic construct
aacaagcucucucugcugauu

SEQ ID NO: 6532 - RNA, 21 nt, Artificial Sequence
  Synthetic construct
uuagcuuuaaccuccugaagc

SEQ ID NO: 6533 - RNA, 21 nt, Artificial Sequence
  Synthetic construct
acaaucaugcaggaacggccu

SEQ ID NO: 6534 - RNA, 21 nt, Artificial Sequence
  Synthetic construct
caaauguucacugcaccacug

SEQ ID NO: 6535 - RNA, 21 nt, Artificial Sequence
  Synthetic construct
acaagggucuccacauucuca

SEQ ID NO: 6536 - RNA, 21 nt, Artificial Sequence
  Synthetic construct
aucuuccugucguuccaacuc

SEQ ID NO: 6537 - RNA, 21 nt, Artificial Sequence
  Synthetic construct
aacuucuuguccacaucaaug

SEQ ID NO: 6538 - RNA, 21 nt, Artificial Sequence
  Synthetic construct
augagauuacauaggugguua

SEQ ID NO: 6539 - RNA, 21 nt, Artificial Sequence
  Synthetic construct
aaucaugcaggaacggccucg

SEQ ID NO: 6540 - RNA, 21 nt, Artificial Sequence
  Synthetic construct
uucagaucagguguuggauga

SEQ ID NO: 6541 - RNA, 21 nt, Artificial Sequence
  Synthetic construct
cugauugagaagaugcuguga

SEQ ID NO: 6542 - RNA, 21 nt, Artificial Sequence
  Synthetic construct
caacuugcugucacggaaggg

SEQ ID NO: 6543 - RNA, 21 nt, Artificial Sequence
  Synthetic construct
auuaccucauuggagagcaag

SEQ ID NO: 6544 - RNA, 21 nt, Artificial Sequence
  Synthetic construct
guaauuuagcuuuaaccuccu

SEQ ID NO: 6545 - RNA, 21 nt, Artificial Sequence
  Synthetic construct
ucaaacaugggagaaacuacg

SEQ ID NO: 6546 - RNA, 21 nt, Artificial Sequence
  Synthetic construct
uccacaacuuguaggagcucc

SEQ ID NO: 6547 - RNA, 21 nt, Artificial Sequence
  Synthetic construct
uggucaaggcuugacgaaguu

SEQ ID NO: 6548 - RNA, 21 nt, Artificial Sequence
  Synthetic construct
cuguucuaccaucucauugca

SEQ ID NO: 6549 - RNA, 21 nt, Artificial Sequence
  Synthetic construct
ugcuuugcacugcuguaauuu

SEQ ID NO: 6550 - RNA, 21 nt, Artificial Sequence
  Synthetic construct
ugguacacugacugauagaag

SEQ ID NO: 6551 - RNA, 21 nt, Artificial Sequence
  Synthetic construct
ugauccucgcauagccgcaaa

SEQ ID NO: 6552 - RNA, 21 nt, Artificial Sequence
  Synthetic construct
cucagcaauacaugcugccuu

SEQ ID NO: 6553 - RNA, 21 nt, Artificial Sequence
  Synthetic construct
agaucacagagugacagcucg

SEQ ID NO: 6554 - RNA, 21 nt, Artificial Sequence
  Synthetic construct
ccacucuucugaucuuugcag

SEQ ID NO: 6555 - RNA, 21 nt, Artificial Sequence
  Synthetic construct
uucauacauuuccuccaauag

SEQ ID NO: 6556 - RNA, 21 nt, Artificial Sequence
  Synthetic construct
agugacuccauauguauagau

SEQ ID NO: 6557 - RNA, 21 nt, Artificial Sequence
  Synthetic construct
ucuaccaucucauugcaaauu

SEQ ID NO: 6558 - RNA, 21 nt, Artificial Sequence
  Synthetic construct
caacaagcucucucugcugau

SEQ ID NO: 6559 - RNA, 21 nt, Artificial Sequence
  Synthetic construct
caacagccuuauauucuucug

SEQ ID NO: 6560 - RNA, 21 nt, Artificial Sequence
  Synthetic construct
caaagucugccucuugcgcug

SEQ ID NO: 6561 - RNA, 21 nt, Artificial Sequence
  Synthetic construct
ugguccuguuugauuaagaug

SEQ ID NO: 6562 - RNA, 21 nt, Artificial Sequence
  Synthetic construct
cacagagugacagcucgcuga

SEQ ID NO: 6563 - RNA, 21 nt, Artificial Sequence
  Synthetic construct
uggugguuguugguuugguug

SEQ ID NO: 6564 - RNA, 21 nt, Artificial Sequence
  Synthetic construct
uuccuucaaccguucaccacu

SEQ ID NO: 6565 - RNA, 21 nt, Artificial Sequence
  Synthetic construct
auccuugaugguaccuugaau

SEQ ID NO: 6566 - RNA, 21 nt, Artificial Sequence
  Synthetic construct
acaacccugaucuuccugucg

SEQ ID NO: 6567 - RNA, 21 nt, Artificial Sequence
  Synthetic construct
ucauacauuuccuccaauagu

SEQ ID NO: 6568 - RNA, 21 nt, Artificial Sequence
  Synthetic construct
cucagauggaaccugcugcuu

SEQ ID NO: 6569 - RNA, 21 nt, Artificial Sequence
  Synthetic construct
agaaacuacgacaucgucauc

SEQ ID NO: 6570 - RNA, 21 nt, Artificial Sequence
  Synthetic construct
ucgaaggaaugguuucuuccc

SEQ ID NO: 6571 - RNA, 21 nt, Artificial Sequence
  Synthetic construct
aauguuugccgggacagguag

SEQ ID NO: 6572 - RNA, 21 nt, Artificial Sequence
  Synthetic construct
ucaucucggagaugcaucucc

SEQ ID NO: 6573 - RNA, 21 nt, Artificial Sequence
  Synthetic construct
auagcagguucuugcguacca

SEQ ID NO: 6574 - RNA, 21 nt, Artificial Sequence
  Synthetic construct
gauguagacacuccucuucaa

SEQ ID NO: 6575 - RNA, 21 nt, Artificial Sequence
  Synthetic construct
ugguucuuacgacccacuuuu

SEQ ID NO: 6576 - RNA, 21 nt, Artificial Sequence
  Synthetic construct
uuccugauauaugguaaagca

SEQ ID NO: 6577 - RNA, 21 nt, Artificial Sequence
  Synthetic construct
augcugugacugcggcuggag

SEQ ID NO: 6578 - RNA, 21 nt, Artificial Sequence
  Synthetic construct
aacuugcugucacggaaggga

SEQ ID NO: 6579 - RNA, 21 nt, Artificial Sequence
  Synthetic construct
uccauacuguccucagaugga

SEQ ID NO: 6580 - RNA, 21 nt, Artificial Sequence
  Synthetic construct
aguccuugggugcuuguagaa

SEQ ID NO: 6581 - RNA, 21 nt, Artificial Sequence
  Synthetic construct
ugacgaagggcagcaauacag

SEQ ID NO: 6582 - RNA, 21 nt, Artificial Sequence
  Synthetic construct
auguucacugcaccacuguuc

SEQ ID NO: 6583 - RNA, 21 nt, Artificial Sequence
  Synthetic construct
acuacgacaucgucaucggac

SEQ ID NO: 6584 - RNA, 21 nt, Artificial Sequence
  Synthetic construct
ugacugcggcuggaguucugg

SEQ ID NO: 6585 - RNA, 21 nt, Artificial Sequence
  Synthetic construct
acggaagggaaccagguucug

SEQ ID NO: 6586 - RNA, 21 nt, Artificial Sequence
  Synthetic construct
acaucaauggugaagggcuug

SEQ ID NO: 6587 - RNA, 21 nt, Artificial Sequence
  Synthetic construct
guagaguuuagcucugcuuug

SEQ ID NO: 6588 - RNA, 21 nt, Artificial Sequence
  Synthetic construct
uucagacccugauugcugaug

SEQ ID NO: 6589 - RNA, 21 nt, Artificial Sequence
  Synthetic construct
ucaccacucuucugaucuuug

SEQ ID NO: 6590 - RNA, 21 nt, Artificial Sequence
  Synthetic construct
uagagagguguuaauguuucc

SEQ ID NO: 6591 - RNA, 21 nt, Artificial Sequence
  Synthetic construct
agaguuucaucauagguagau

SEQ ID NO: 6592 - RNA, 21 nt, Artificial Sequence
  Synthetic construct
ccagguucugcuuugaccggu

SEQ ID NO: 6593 - RNA, 21 nt, Artificial Sequence
  Synthetic construct
aagagagcuucuagcucuuca

SEQ ID NO: 6594 - RNA, 21 nt, Artificial Sequence
  Synthetic construct
ucagguguuggaugaaguugg

SEQ ID NO: 6595 - RNA, 21 nt, Artificial Sequence
  Synthetic construct
uucuaccaucucauugcaaau

SEQ ID NO: 6596 - RNA, 21 nt, Artificial Sequence
  Synthetic construct
uucgcagccgcagagcacaac

SEQ ID NO: 6597 - RNA, 21 nt, Artificial Sequence
  Synthetic construct
cugguugguaccaaggcgcuu

SEQ ID NO: 6598 - RNA, 21 nt, Artificial Sequence
  Synthetic construct
aucccuccauccuugauggua

SEQ ID NO: 6599 - RNA, 21 nt, Artificial Sequence
  Synthetic construct
ugugcauagaaaucauauaag

SEQ ID NO: 6600 - RNA, 21 nt, Artificial Sequence
  Synthetic construct
acuccuugaggauauuuaguu

SEQ ID NO: 6601 - RNA, 21 nt, Artificial Sequence
  Synthetic construct
agcaauacaugcugccuucuu

SEQ ID NO: 6602 - RNA, 21 nt, Artificial Sequence
  Synthetic construct
uucuuccgaagguccaguuuc

SEQ ID NO: 6603 - RNA, 21 nt, Artificial Sequence
  Synthetic construct
guuucugaagcucuguccgca

SEQ ID NO: 6604 - RNA, 21 nt, Artificial Sequence
  Synthetic construct
gaucugcuugcugucuagcca

SEQ ID NO: 6605 - RNA, 21 nt, Artificial Sequence
  Synthetic construct
gucguuccaacucugaaggua

SEQ ID NO: 6606 - RNA, 21 nt, Artificial Sequence
  Synthetic construct
aaggaaugguuucuucccugg

SEQ ID NO: 6607 - RNA, 21 nt, Artificial Sequence
  Synthetic construct
gaagcuggacuuucgcagccg

SEQ ID NO: 6608 - RNA, 21 nt, Artificial Sequence
  Synthetic construct
aauucagacccugauugcuga

SEQ ID NO: 6609 - RNA, 21 nt, Artificial Sequence
  Synthetic construct
uccaggccuccucagcaucuu

SEQ ID NO: 6610 - RNA, 21 nt, Artificial Sequence
  Synthetic construct
cagagcagucugauagcaggu

SEQ ID NO: 6611 - RNA, 21 nt, Artificial Sequence
  Synthetic construct
acauuuccuccaauaguuccu

SEQ ID NO: 6612 - RNA, 21 nt, Artificial Sequence
  Synthetic construct
agcuggacuuucgcagccgca

SEQ ID NO: 6613 - RNA, 21 nt, Artificial Sequence
  Synthetic construct
auuuccuccugucggaucugc

SEQ ID NO: 6614 - RNA, 21 nt, Artificial Sequence
  Synthetic construct
acggacacaacccugaucuuc

SEQ ID NO: 6615 - RNA, 21 nt, Artificial Sequence
  Synthetic construct
auuggagagcaagggcuucag

SEQ ID NO: 6616 - RNA, 21 nt, Artificial Sequence
  Synthetic construct
uccuucaaccguucaccacuc

SEQ ID NO: 6617 - RNA, 21 nt, Artificial Sequence
  Synthetic construct
uacuuucaccuucuccauacu

SEQ ID NO: 6618 - RNA, 21 nt, Artificial Sequence
  Synthetic construct
ucaccaaguuucugaagcucu

SEQ ID NO: 6619 - RNA, 21 nt, Artificial Sequence
  Synthetic construct
aguagcugacccaccucaggg

SEQ ID NO: 6620 - RNA, 21 nt, Artificial Sequence
  Synthetic construct
uccugaagcugcuggguggag

SEQ ID NO: 6621 - RNA, 21 nt, Artificial Sequence
  Synthetic construct
uugcauccuggauauaauucc

SEQ ID NO: 6622 - RNA, 21 nt, Artificial Sequence
  Synthetic construct
agaguuuagcucugcuuugca

SEQ ID NO: 6623 - RNA, 21 nt, Artificial Sequence
  Synthetic construct
cuucauuuccuccugucggau

SEQ ID NO: 6624 - RNA, 21 nt, Artificial Sequence
  Synthetic construct
acugucgaagcuggugcuggu

SEQ ID NO: 6625 - RNA, 21 nt, Artificial Sequence
  Synthetic construct
aaguaaauuucgaaggaaugg

SEQ ID NO: 6626 - RNA, 21 nt, Artificial Sequence
  Synthetic construct
ucagcaauacaugcugccuuc

SEQ ID NO: 6627 - RNA, 21 nt, Artificial Sequence
  Synthetic construct
uucccuggugguuguugguuu

SEQ ID NO: 6628 - RNA, 21 nt, Artificial Sequence
  Synthetic construct
cugucgaagcuggugcuggua

SEQ ID NO: 6629 - RNA, 21 nt, Artificial Sequence
  Synthetic construct
aguaaauuucgaaggaauggu

SEQ ID NO: 6630 - RNA, 21 nt, Artificial Sequence
  Synthetic construct
cugcaagagagcuucuagcuc

SEQ ID NO: 6631 - RNA, 21 nt, Artificial Sequence
  Synthetic construct
uccugguugguaccaaggcgc

SEQ ID NO: 6632 - RNA, 21 nt, Artificial Sequence
  Synthetic construct
aagguccaguuucacuagcac

SEQ ID NO: 6633 - RNA, 21 nt, Artificial Sequence
  Synthetic construct
uuacauaggugguuauaauac

SEQ ID NO: 6634 - RNA, 21 nt, Artificial Sequence
  Synthetic construct
auagguagaugcacagggauu

SEQ ID NO: 6635 - RNA, 21 nt, Artificial Sequence
  Synthetic construct
cuugaugaacgagugcaggga

SEQ ID NO: 6636 - RNA, 21 nt, Artificial Sequence
  Synthetic construct
ccauauguauagaugagccag

SEQ ID NO: 6637 - RNA, 21 nt, Artificial Sequence
  Synthetic construct
cugcugcuuguccucuaggga

SEQ ID NO: 6638 - RNA, 21 nt, Artificial Sequence
  Synthetic construct
ucuccauacuguccucagaug

SEQ ID NO: 6639 - RNA, 21 nt, Artificial Sequence
  Synthetic construct
cuggugcugguaccuauccga

SEQ ID NO: 6640 - RNA, 21 nt, Artificial Sequence
  Synthetic construct
ugcucagcaauacaugcugcc

SEQ ID NO: 6641 - RNA, 21 nt, Artificial Sequence
  Synthetic construct
acaugggagaaacuacgacau

SEQ ID NO: 6642 - RNA, 21 nt, Artificial Sequence
  Synthetic construct
cuacugcugguacacugacug

SEQ ID NO: 6643 - RNA, 21 nt, Artificial Sequence
  Synthetic construct
agugguagaguuuagcucugc

SEQ ID NO: 6644 - RNA, 21 nt, Artificial Sequence
  Synthetic construct
uccgaagguccaguuucacua

SEQ ID NO: 6645 - RNA, 21 nt, Artificial Sequence
  Synthetic construct
uguucccgcuguugcaucugu

SEQ ID NO: 6646 - RNA, 21 nt, Artificial Sequence
  Synthetic construct
acagggauucacauugacaau

SEQ ID NO: 6647 - RNA, 21 nt, Artificial Sequence
  Synthetic construct
ugaugaacgagugcagggaug

SEQ ID NO: 6648 - RNA, 21 nt, Artificial Sequence
  Synthetic construct
aggaaugguuucuucccuggu

SEQ ID NO: 6649 - RNA, 21 nt, Artificial Sequence
  Synthetic construct
cucuucugaucuuugcagcgc

SEQ ID NO: 6650 - RNA, 21 nt, Artificial Sequence
  Synthetic construct
acacuccucuucaaggaagug

SEQ ID NO: 6651 - RNA, 21 nt, Artificial Sequence
  Synthetic construct
ugugcccaucgaugacuuguu

SEQ ID NO: 6652 - RNA, 21 nt, Artificial Sequence
  Synthetic construct
ucuguccgcaacagccuuaua

SEQ ID NO: 6653 - RNA, 21 nt, Artificial Sequence
  Synthetic construct
aauaggucauaaagcaguucg

SEQ ID NO: 6654 - RNA, 21 nt, Artificial Sequence
  Synthetic construct
cuccucagcaucuugcacaug

SEQ ID NO: 6655 - RNA, 21 nt, Artificial Sequence
  Synthetic construct
cuuaugcaacucuucaguggu

SEQ ID NO: 6656 - RNA, 21 nt, Artificial Sequence
  Synthetic construct
guacacugacugauagaagag

SEQ ID NO: 6657 - RNA, 21 nt, Artificial Sequence
  Synthetic construct
ugaagacuauguuccuugaug

SEQ ID NO: 6658 - RNA, 21 nt, Artificial Sequence
  Synthetic construct
gagguagagacgacagagcag

SEQ ID NO: 6659 - RNA, 21 nt, Artificial Sequence
  Synthetic construct
cuuguccacaucaauggugaa

SEQ ID NO: 6660 - RNA, 21 nt, Artificial Sequence
  Synthetic construct
ugaguauugcauccuggauau

SEQ ID NO: 6661 - RNA, 21 nt, Artificial Sequence
  Synthetic construct
cuucugaucuuugcagcgcuc

SEQ ID NO: 6662 - RNA, 21 nt, Artificial Sequence
  Synthetic construct
ucuagggagguagagacgaca

SEQ ID NO: 6663 - RNA, 21 nt, Artificial Sequence
  Synthetic construct
ucccgcuccugaaucucuucu

SEQ ID NO: 6664 - RNA, 21 nt, Artificial Sequence
  Synthetic construct
uagguagaugcacagggauuc

SEQ ID NO: 6665 - RNA, 21 nt, Artificial Sequence
  Synthetic construct
cauuuccuccaauaguuccuu

SEQ ID NO: 6666 - RNA, 21 nt, Artificial Sequence
  Synthetic construct
agcagggacagcuucuucauu

SEQ ID NO: 6667 - RNA, 21 nt, Artificial Sequence
  Synthetic construct
ucugcuuugcacugcuguaau

SEQ ID NO: 6668 - RNA, 21 nt, Artificial Sequence
  Synthetic construct
uguagaucucaaagaaugaga

SEQ ID NO: 6669 - RNA, 21 nt, Artificial Sequence
  Synthetic construct
gcuagugucugaguauugcau

SEQ ID NO: 6670 - RNA, 21 nt, Artificial Sequence
  Synthetic construct
acugcaccacuguucccgcug

SEQ ID NO: 6671 - RNA, 21 nt, Artificial Sequence
  Synthetic construct
aauaauaucuuuaauauaacu

SEQ ID NO: 6672 - RNA, 21 nt, Artificial Sequence
  Synthetic construct
aucggacagcaagcccgcugg

SEQ ID NO: 6673 - RNA, 21 nt, Artificial Sequence
  Synthetic construct
uccugcuuccuucaaccguuc

SEQ ID NO: 6674 - RNA, 21 nt, Artificial Sequence
  Synthetic construct
uauguuccuugaugaacgagu

SEQ ID NO: 6675 - RNA, 21 nt, Artificial Sequence
  Synthetic construct
agguugaagaaggaugccugu

SEQ ID NO: 6676 - RNA, 21 nt, Artificial Sequence
  Synthetic construct
caauaucaucaucaaggccug

SEQ ID NO: 6677 - RNA, 21 nt, Artificial Sequence
  Synthetic construct
agaccuauuucuucaggagag

SEQ ID NO: 6678 - RNA, 21 nt, Artificial Sequence
  Synthetic construct
guuguucugcaguucagccag

SEQ ID NO: 6679 - RNA, 21 nt, Artificial Sequence
  Synthetic construct
cugcagucuguugagcuuugg

SEQ ID NO: 6680 - RNA, 21 nt, Artificial Sequence
  Synthetic construct
aguacauccuuuaccaucucc

SEQ ID NO: 6681 - RNA, 21 nt, Artificial Sequence
  Synthetic construct
caugaauccaguugagaucuu

SEQ ID NO: 6682 - RNA, 21 nt, Artificial Sequence
  Synthetic construct
caucggacagcaagcccgcug

SEQ ID NO: 6683 - RNA, 21 nt, Artificial Sequence
  Synthetic construct
cuccugucggaucugcuugcu

SEQ ID NO: 6684 - RNA, 21 nt, Artificial Sequence
  Synthetic construct
aucuuugcagcgcucugagcc

SEQ ID NO: 6685 - RNA, 21 nt, Artificial Sequence
  Synthetic construct
aagggucuccacauucucaau

SEQ ID NO: 6686 - RNA, 21 nt, Artificial Sequence
  Synthetic construct
aauacggacacaacccugauc

SEQ ID NO: 6687 - RNA, 21 nt, Artificial Sequence
  Synthetic construct
cauuuccuccugucggaucug

SEQ ID NO: 6688 - RNA, 21 nt, Artificial Sequence
  Synthetic construct
ucacugcaccacuguucccgc

SEQ ID NO: 6689 - RNA, 21 nt, Artificial Sequence
  Synthetic construct
aguuagugacuccauauguau

SEQ ID NO: 6690 - RNA, 21 nt, Artificial Sequence
  Synthetic construct
aucuuucacauagggauugcc

SEQ ID NO: 6691 - RNA, 21 nt, Artificial Sequence
  Synthetic construct
agauggaaccugcugcuuguc

SEQ ID NO: 6692 - RNA, 21 nt, Artificial Sequence
  Synthetic construct
auagaaaucauauaaguaaau

SEQ ID NO: 6693 - RNA, 21 nt, Artificial Sequence
  Synthetic construct
agagaccuauuucuucaggag

SEQ ID NO: 6694 - RNA, 21 nt, Artificial Sequence
  Synthetic construct
ugagcguaggauccgggcaua

SEQ ID NO: 6695 - RNA, 21 nt, Artificial Sequence
  Synthetic construct
ucguuccaacucugaagguaa

SEQ ID NO: 6696 - RNA, 21 nt, Artificial Sequence
  Synthetic construct
caagggucuccacauucucaa

SEQ ID NO: 6697 - RNA, 21 nt, Artificial Sequence
  Synthetic construct
gaaccugcugcuuguccucua

SEQ ID NO: 6698 - RNA, 21 nt, Artificial Sequence
  Synthetic construct
aggcuauugaagaucagcgcc

SEQ ID NO: 6699 - RNA, 21 nt, Artificial Sequence
  Synthetic construct
cuagucgccgaagcuggacuu

SEQ ID NO: 6700 - RNA, 21 nt, Artificial Sequence
  Synthetic construct
augggagaaacuacgacaucg

SEQ ID NO: 6701 - RNA, 21 nt, Artificial Sequence
  Synthetic construct
cuuccuucaaccguucaccac

SEQ ID NO: 6702 - RNA, 21 nt, Artificial Sequence
  Synthetic construct
augcugccuucuuccgaaggu

SEQ ID NO: 6703 - RNA, 21 nt, Artificial Sequence
  Synthetic construct
cuucuaacuucuuguccacau

SEQ ID NO: 6704 - RNA, 21 nt, Artificial Sequence
  Synthetic construct
agaagaugcugugacugcggc

SEQ ID NO: 6705 - RNA, 21 nt, Artificial Sequence
  Synthetic construct
uucccgcuguugcaucuguuc

SEQ ID NO: 6706 - RNA, 21 nt, Artificial Sequence
  Synthetic construct
caacccugaucuuccugucgu

SEQ ID NO: 6707 - RNA, 21 nt, Artificial Sequence
  Synthetic construct
aauuucgaaggaaugguuucu

SEQ ID NO: 6708 - RNA, 21 nt, Artificial Sequence
  Synthetic construct
agagagguguuaauguuuccu

SEQ ID NO: 6709 - RNA, 21 nt, Artificial Sequence
  Synthetic construct
gaugucaucacaaguggucaa

SEQ ID NO: 6710 - RNA, 21 nt, Artificial Sequence
  Synthetic construct
aagggcagcaauacagcggcc

SEQ ID NO: 6711 - RNA, 21 nt, Artificial Sequence
  Synthetic construct
aucaugcaggaacggccucgg

SEQ ID NO: 6712 - RNA, 21 nt, Artificial Sequence
  Synthetic construct
gcauccuggauauaauuccug

SEQ ID NO: 6713 - RNA, 21 nt, Artificial Sequence
  Synthetic construct
caacucuucagugguagaguu

SEQ ID NO: 6714 - RNA, 21 nt, Artificial Sequence
  Synthetic construct
ucuguucuaccaucucauugc

SEQ ID NO: 6715 - RNA, 21 nt, Artificial Sequence
  Synthetic construct
acgccgugagcguaggauccg

SEQ ID NO: 6716 - RNA, 21 nt, Artificial Sequence
  Synthetic construct
aaugagauccagauggagaag

SEQ ID NO: 6717 - RNA, 21 nt, Artificial Sequence
  Synthetic construct
acaagcucucucugcugauug

SEQ ID NO: 6718 - RNA, 21 nt, Artificial Sequence
  Synthetic construct
ucucaaagaaugagauccaga

SEQ ID NO: 6719 - RNA, 21 nt, Artificial Sequence
  Synthetic construct
ugguugguaccaaggcgcuuu

SEQ ID NO: 6720 - RNA, 21 nt, Artificial Sequence
  Synthetic construct
aguauacuuucaccuucucca

SEQ ID NO: 6721 - RNA, 21 nt, Artificial Sequence
  Synthetic construct
aaauuucaucucggagaugca

SEQ ID NO: 6722 - RNA, 21 nt, Artificial Sequence
  Synthetic construct
ucucggagaugcaucuccagc

SEQ ID NO: 6723 - RNA, 21 nt, Artificial Sequence
  Synthetic construct
cugaagcucuguccgcaacag

SEQ ID NO: 6724 - RNA, 21 nt, Artificial Sequence
  Synthetic construct
guuaauguuuccugcuuccuu

SEQ ID NO: 6725 - RNA, 21 nt, Artificial Sequence
  Synthetic construct
uucgaaggaaugguuucuucc

SEQ ID NO: 6726 - RNA, 21 nt, Artificial Sequence
  Synthetic construct
cugaagguguaggauccugau

SEQ ID NO: 6727 - RNA, 21 nt, Artificial Sequence
  Synthetic construct
aauacagcggcccagggugug

SEQ ID NO: 6728 - RNA, 21 nt, Artificial Sequence
  Synthetic construct
guaggagcuccucuuugccau

SEQ ID NO: 6729 - RNA, 21 nt, Artificial Sequence
  Synthetic construct
acgaagggcagcaauacagcg

SEQ ID NO: 6730 - RNA, 21 nt, Artificial Sequence
  Synthetic construct
agaagcgaauguuugccggga

SEQ ID NO: 6731 - RNA, 21 nt, Artificial Sequence
  Synthetic construct
cacuagcaccauguuguucug

SEQ ID NO: 6732 - RNA, 21 nt, Artificial Sequence
  Synthetic construct
gagaagaugcugugacugcgg

SEQ ID NO: 6733 - RNA, 21 nt, Artificial Sequence
  Synthetic construct
agacucaccaaguuucugaag

SEQ ID NO: 6734 - RNA, 21 nt, Artificial Sequence
  Synthetic construct
aguaugauacugcucagcaau

SEQ ID NO: 6735 - RNA, 21 nt, Artificial Sequence
  Synthetic construct
cagccuagguccgaagacgug

SEQ ID NO: 6736 - RNA, 21 nt, Artificial Sequence
  Synthetic construct
caucauagguagaugcacagg

SEQ ID NO: 6737 - RNA, 21 nt, Artificial Sequence
  Synthetic construct
cugcuuguccucuagggaggu

SEQ ID NO: 6738 - RNA, 21 nt, Artificial Sequence
  Synthetic construct
acagagcagucugauagcagg

SEQ ID NO: 6739 - RNA, 21 nt, Artificial Sequence
  Synthetic construct
uccgacuuucgauguagacac

SEQ ID NO: 6740 - RNA, 21 nt, Artificial Sequence
  Synthetic construct
agggagguagagacgacagag

SEQ ID NO: 6741 - RNA, 21 nt, Artificial Sequence
  Synthetic construct
agagcaagggcuucagaucag

SEQ ID NO: 6742 - RNA, 21 nt, Artificial Sequence
  Synthetic construct
caaacaugggagaaacuacga

SEQ ID NO: 6743 - RNA, 21 nt, Artificial Sequence
  Synthetic construct
auacugcucagcaauacaugc

SEQ ID NO: 6744 - RNA, 21 nt, Artificial Sequence
  Synthetic construct
acucugaagguaacaagggcc

SEQ ID NO: 6745 - RNA, 21 nt, Artificial Sequence
  Synthetic construct
acacaacccugaucuuccugu

SEQ ID NO: 6746 - RNA, 21 nt, Artificial Sequence
  Synthetic construct
cauccuugaugguaccuugaa

SEQ ID NO: 6747 - RNA, 21 nt, Artificial Sequence
  Synthetic construct
cacugcaccacuguucccgcu

SEQ ID NO: 6748 - RNA, 21 nt, Artificial Sequence
  Synthetic construct
uggagagcaagggcuucagau

SEQ ID NO: 6749 - RNA, 21 nt, Artificial Sequence
  Synthetic construct
guagacacuccucuucaagga

SEQ ID NO: 6750 - RNA, 21 nt, Artificial Sequence
  Synthetic construct
cuugggugcuuguagaacaag

SEQ ID NO: 6751 - RNA, 21 nt, Artificial Sequence
  Synthetic construct
gucggaucugcuugcugucua

SEQ ID NO: 6752 - RNA, 21 nt, Artificial Sequence
  Synthetic construct
uagaagagagcccagcaaugc

SEQ ID NO: 6753 - RNA, 21 nt, Artificial Sequence
  Synthetic construct
uccuucacaguuagguugaag

SEQ ID NO: 6754 - RNA, 21 nt, Artificial Sequence
  Synthetic construct
ucuuccgaagguccaguuuca

SEQ ID NO: 6755 - RNA, 21 nt, Artificial Sequence
  Synthetic construct
cucgcauagccgcaaagucug

SEQ ID NO: 6756 - RNA, 21 nt, Artificial Sequence
  Synthetic construct
cuaauaggucauaaagcaguu

SEQ ID NO: 6757 - RNA, 21 nt, Artificial Sequence
  Synthetic construct
acugcggcuggaguucugguu

SEQ ID NO: 6758 - RNA, 21 nt, Artificial Sequence
  Synthetic construct
caucacaaguggucaaggcuu

SEQ ID NO: 6759 - RNA, 21 nt, Artificial Sequence
  Synthetic construct
ccucuucuaacuucuugucca

SEQ ID NO: 6760 - RNA, 21 nt, Artificial Sequence
  Synthetic construct
acucaaacaugggagaaacua

SEQ ID NO: 6761 - RNA, 21 nt, Artificial Sequence
  Synthetic construct
augcaggaacggccucggccu

SEQ ID NO: 6762 - RNA, 21 nt, Artificial Sequence
  Synthetic construct
ggcaacaagcucucucugcug

SEQ ID NO: 6763 - RNA, 21 nt, Artificial Sequence
  Synthetic construct
gucauaaagcaguucguugua

SEQ ID NO: 6764 - RNA, 21 nt, Artificial Sequence
  Synthetic construct
guccucagauggaaccugcug

SEQ ID NO: 6765 - RNA, 21 nt, Artificial Sequence
  Synthetic construct
gaaggaaugguuucuucccug

SEQ ID NO: 6766 - RNA, 21 nt, Artificial Sequence
  Synthetic construct
cuucuagcucuucaaucuuuu

SEQ ID NO: 6767 - RNA, 21 nt, Artificial Sequence
  Synthetic construct
uccuggauauaauuccugaua

SEQ ID NO: 6768 - RNA, 21 nt, Artificial Sequence
  Synthetic construct
ucccgcuguugcaucuguucu

SEQ ID NO: 6769 - RNA, 21 nt, Artificial Sequence
  Synthetic construct
caauacggacacaacccugau

SEQ ID NO: 6770 - RNA, 21 nt, Artificial Sequence
  Synthetic construct
agucugguccuguuugauuaa

SEQ ID NO: 6771 - RNA, 21 nt, Artificial Sequence
  Synthetic construct
ucacggaagggaaccagguuc

SEQ ID NO: 6772 - RNA, 21 nt, Artificial Sequence
  Synthetic construct
ugccgggacagguaguggggc

SEQ ID NO: 6773 - RNA, 21 nt, Artificial Sequence
  Synthetic construct
cacugcuguaauuuagcuuua

SEQ ID NO: 6774 - RNA, 21 nt, Artificial Sequence
  Synthetic construct
uggauauaauuccugauauau

SEQ ID NO: 6775 - RNA, 21 nt, Artificial Sequence
  Synthetic construct
aggaugccugucccacuucug

SEQ ID NO: 6776 - RNA, 21 nt, Artificial Sequence
  Synthetic construct
ugauagcagguucuugcguac

SEQ ID NO: 6777 - RNA, 21 nt, Artificial Sequence
  Synthetic construct
acuuucgcagccgcagagcac

SEQ ID NO: 6778 - RNA, 21 nt, Artificial Sequence
  Synthetic construct
uucauuuccuccugucggauc

SEQ ID NO: 6779 - RNA, 21 nt, Artificial Sequence
  Synthetic construct
gaagggaaccagguucugcuu

SEQ ID NO: 6780 - RNA, 21 nt, Artificial Sequence
  Synthetic construct
uccucagcaucuugcacauga

SEQ ID NO: 6781 - RNA, 21 nt, Artificial Sequence
  Synthetic construct
gaguacauccuuuaccaucuc

SEQ ID NO: 6782 - RNA, 21 nt, Artificial Sequence
  Synthetic construct
caucucggagaugcaucucca

SEQ ID NO: 6783 - RNA, 21 nt, Artificial Sequence
  Synthetic construct
gugaacaauaauaucuuuaau

SEQ ID NO: 6784 - RNA, 21 nt, Artificial Sequence
  Synthetic construct
cugucggaucugcuugcuguc

SEQ ID NO: 6785 - RNA, 21 nt, Artificial Sequence
  Synthetic construct
uccucuagggagguagagacg

SEQ ID NO: 6786 - RNA, 21 nt, Artificial Sequence
  Synthetic construct
agaaggaugccugucccacuu

SEQ ID NO: 6787 - RNA, 21 nt, Artificial Sequence
  Synthetic construct
gagucaacuugcugucacgga

SEQ ID NO: 6788 - RNA, 21 nt, Artificial Sequence
  Synthetic construct
uguugguuugguugcugauuu

SEQ ID NO: 6789 - RNA, 21 nt, Artificial Sequence
  Synthetic construct
agaugcugugacugcggcugg

SEQ ID NO: 6790 - RNA, 21 nt, Artificial Sequence
  Synthetic construct
aguggacagcuccuccucuug

SEQ ID NO: 6791 - RNA, 21 nt, Artificial Sequence
  Synthetic construct
ugcugccuucuuccgaagguc

SEQ ID NO: 6792 - RNA, 21 nt, Artificial Sequence
  Synthetic construct
caaggaaguggacagcuccuc

SEQ ID NO: 6793 - RNA, 21 nt, Artificial Sequence
  Synthetic construct
gacagagcagucugauagcag

SEQ ID NO: 6794 - RNA, 21 nt, Artificial Sequence
  Synthetic construct
cuguggacucaaacaugggag

SEQ ID NO: 6795 - RNA, 21 nt, Artificial Sequence
  Synthetic construct
ugaaucucuucuugguaaaaa

SEQ ID NO: 6796 - RNA, 21 nt, Artificial Sequence
  Synthetic construct
accuccugaagcugcugggug

SEQ ID NO: 6797 - RNA, 21 nt, Artificial Sequence
  Synthetic construct
cucaaguauacuuucaccuuc

SEQ ID NO: 6798 - RNA, 21 nt, Artificial Sequence
  Synthetic construct
gcuauugaagaucagcgccag

SEQ ID NO: 6799 - RNA, 21 nt, Artificial Sequence
  Synthetic construct
accguucaccacucuucugau

SEQ ID NO: 6800 - RNA, 21 nt, Artificial Sequence
  Synthetic construct
uccuccucuuggaggccucca

SEQ ID NO: 6801 - RNA, 21 nt, Artificial Sequence
  Synthetic construct
uccucagauggaaccugcugc

SEQ ID NO: 6802 - RNA, 21 nt, Artificial Sequence
  Synthetic construct
auaggugguuauaauacaaaa

SEQ ID NO: 6803 - RNA, 21 nt, Artificial Sequence
  Synthetic construct
cacaucaauggugaagggcuu

SEQ ID NO: 6804 - RNA, 21 nt, Artificial Sequence
  Synthetic construct
caagagagcuucuagcucuuc

SEQ ID NO: 6805 - RNA, 21 nt, Artificial Sequence
  Synthetic construct
gcuucuagcucuucaaucuuu

SEQ ID NO: 6806 - RNA, 21 nt, Artificial Sequence
  Synthetic construct
uccgcaacagccuuauauucu

SEQ ID NO: 6807 - RNA, 21 nt, Artificial Sequence
  Synthetic construct
ucccuggugguuguugguuug

SEQ ID NO: 6808 - RNA, 21 nt, Artificial Sequence
  Synthetic construct
cacucgagucaacuugcuguc

SEQ ID NO: 6809 - RNA, 21 nt, Artificial Sequence
  Synthetic construct
gacugcucuucucuuucccca

SEQ ID NO: 6810 - RNA, 21 nt, Artificial Sequence
  Synthetic construct
gagagacucaccaaguuucug

SEQ ID NO: 6811 - RNA, 21 nt, Artificial Sequence
  Synthetic construct
gagacgacagagcagucugau

SEQ ID NO: 6812 - RNA, 21 nt, Artificial Sequence
  Synthetic construct
uucuucccuggugguuguugg

SEQ ID NO: 6813 - RNA, 21 nt, Artificial Sequence
  Synthetic construct
ucagugacuccuugaggauau

SEQ ID NO: 6814 - RNA, 21 nt, Artificial Sequence
  Synthetic construct
aggagaguagcugacccaccu

SEQ ID NO: 6815 - RNA, 21 nt, Artificial Sequence
  Synthetic construct
cugacugauagaagagagccc

SEQ ID NO: 6816 - RNA, 21 nt, Artificial Sequence
  Synthetic construct
aucccgcuccugaaucucuuc

SEQ ID NO: 6817 - RNA, 21 nt, Artificial Sequence
  Synthetic construct
guaaauuucgaaggaaugguu

SEQ ID NO: 6818 - RNA, 21 nt, Artificial Sequence
  Synthetic construct
cuuugcacugcuguaauuuag

SEQ ID NO: 6819 - RNA, 21 nt, Artificial Sequence
  Synthetic construct
aacaagggccuaacccucaag

SEQ ID NO: 6820 - RNA, 21 nt, Artificial Sequence
  Synthetic construct
cucugcuuugcacugcuguaa

SEQ ID NO: 6821 - RNA, 21 nt, Artificial Sequence
  Synthetic construct
cuugucagugacuccuugagg

SEQ ID NO: 6822 - RNA, 21 nt, Artificial Sequence
  Synthetic construct
auggagaugucagcuucauuu

SEQ ID NO: 6823 - RNA, 21 nt, Artificial Sequence
  Synthetic construct
gaaacuacgacaucgucaucg

SEQ ID NO: 6824 - RNA, 21 nt, Artificial Sequence
  Synthetic construct
agucugccucuugcgcuguug

SEQ ID NO: 6825 - RNA, 21 nt, Artificial Sequence
  Synthetic construct
gaguuagugacuccauaugua

SEQ ID NO: 6826 - RNA, 21 nt, Artificial Sequence
  Synthetic construct
acaauaauaucuuuaauauaa

SEQ ID NO: 6827 - RNA, 21 nt, Artificial Sequence
  Synthetic construct
uccucuucaaggaaguggaca

SEQ ID NO: 6828 - RNA, 21 nt, Artificial Sequence
  Synthetic construct
guguagagagguguuaauguu

SEQ ID NO: 6829 - RNA, 21 nt, Artificial Sequence
  Synthetic construct
caccaaguuucugaagcucug

SEQ ID NO: 6830 - RNA, 21 nt, Artificial Sequence
  Synthetic construct
acucacaccuagucgccgaag

SEQ ID NO: 6831 - RNA, 21 nt, Artificial Sequence
  Synthetic construct
guucaccacucuucugaucuu

SEQ ID NO: 6832 - RNA, 21 nt, Artificial Sequence
  Synthetic construct
accuauuucuucaggagagua

SEQ ID NO: 6833 - RNA, 21 nt, Artificial Sequence
  Synthetic construct
cgagucaacuugcugucacgg

SEQ ID NO: 6834 - RNA, 21 nt, Artificial Sequence
  Synthetic construct
agagacucaccaaguuucuga

SEQ ID NO: 6835 - RNA, 21 nt, Artificial Sequence
  Synthetic construct
accuugaaucguguggguuuu

SEQ ID NO: 6836 - RNA, 21 nt, Artificial Sequence
  Synthetic construct
cacaguuagguugaagaagga

SEQ ID NO: 6837 - RNA, 21 nt, Artificial Sequence
  Synthetic construct
aggucauaaagcaguucguug

SEQ ID NO: 6838 - RNA, 21 nt, Artificial Sequence
  Synthetic construct
uccucuuggaggccuccauuu

SEQ ID NO: 6839 - RNA, 21 nt, Artificial Sequence
  Synthetic construct
aacaugggagaaacuacgaca

SEQ ID NO: 6840 - RNA, 21 nt, Artificial Sequence
  Synthetic construct
gucugaguauugcauccugga

SEQ ID NO: 6841 - RNA, 21 nt, Artificial Sequence
  Synthetic construct
cuucaaccguucaccacucuu

SEQ ID NO: 6842 - RNA, 21 nt, Artificial Sequence
  Synthetic construct
caguuucacuagcaccauguu

SEQ ID NO: 6843 - RNA, 21 nt, Artificial Sequence
  Synthetic construct
caccuucuccauacuguccuc

SEQ ID NO: 6844 - RNA, 21 nt, Artificial Sequence
  Synthetic construct
aaccuuugugaccgccguagg

SEQ ID NO: 6845 - RNA, 21 nt, Artificial Sequence
  Synthetic construct
cauagccgcaaagucugccuc

SEQ ID NO: 6846 - RNA, 21 nt, Artificial Sequence
  Synthetic construct
cuuucacauagggauugccau

SEQ ID NO: 6847 - RNA, 21 nt, Artificial Sequence
  Synthetic construct
aacccucaaguauacuuucac

SEQ ID NO: 6848 - RNA, 21 nt, Artificial Sequence
  Synthetic construct
caucuguucuaccaucucauu

SEQ ID NO: 6849 - RNA, 21 nt, Artificial Sequence
  Synthetic construct
gucugauagcagguucuugcg

SEQ ID NO: 6850 - RNA, 21 nt, Artificial Sequence
  Synthetic construct
auggagaagcgaauguuugcc

SEQ ID NO: 6851 - RNA, 21 nt, Artificial Sequence
  Synthetic construct
gucuccacauucucaauacgg

SEQ ID NO: 6852 - RNA, 21 nt, Artificial Sequence
  Synthetic construct
auuacauaggugguuauaaua

SEQ ID NO: 6853 - RNA, 21 nt, Artificial Sequence
  Synthetic construct
ugcggcuggaguucugguuga

SEQ ID NO: 6854 - RNA, 21 nt, Artificial Sequence
  Synthetic construct
caaguggucaaggcuugacga

SEQ ID NO: 6855 - RNA, 21 nt, Artificial Sequence
  Synthetic construct
ugaucuuccugucguuccaac

SEQ ID NO: 6856 - RNA, 21 nt, Artificial Sequence
  Synthetic construct
accuagucgccgaagcuggac

SEQ ID NO: 6857 - RNA, 21 nt, Artificial Sequence
  Synthetic construct
cuccuucacaguuagguugaa

SEQ ID NO: 6858 - RNA, 21 nt, Artificial Sequence
  Synthetic construct
aggauccugauugagaagaug

SEQ ID NO: 6859 - RNA, 21 nt, Artificial Sequence
  Synthetic construct
cgucaucggacagcaagcccg

SEQ ID NO: 6860 - RNA, 21 nt, Artificial Sequence
  Synthetic construct
aucugcagcuguggacucaaa

SEQ ID NO: 6861 - RNA, 21 nt, Artificial Sequence
  Synthetic construct
ucacuagcaccauguuguucu

SEQ ID NO: 6862 - RNA, 21 nt, Artificial Sequence
  Synthetic construct
ucaucccgcuccugaaucucu

SEQ ID NO: 6863 - RNA, 21 nt, Artificial Sequence
  Synthetic construct
ucugaagcucuguccgcaaca

SEQ ID NO: 6864 - RNA, 21 nt, Artificial Sequence
  Synthetic construct
gcaucuguucuaccaucucau

SEQ ID NO: 6865 - RNA, 21 nt, Artificial Sequence
  Synthetic construct
agaugcacagggauucacauu

SEQ ID NO: 6866 - RNA, 21 nt, Artificial Sequence
  Synthetic construct
agcucucucugcugauuggag

SEQ ID NO: 6867 - RNA, 21 nt, Artificial Sequence
  Synthetic construct
guuuagcucugcuuugcacug

SEQ ID NO: 6868 - RNA, 21 nt, Artificial Sequence
  Synthetic construct
gagugacagcucgcugaucuu

SEQ ID NO: 6869 - RNA, 21 nt, Artificial Sequence
  Synthetic construct
agguaacaagggccuaacccu

SEQ ID NO: 6870 - RNA, 21 nt, Artificial Sequence
  Synthetic construct
gaagaaaccuuggaacacucg

SEQ ID NO: 6871 - RNA, 21 nt, Artificial Sequence
  Synthetic construct
auauaugguaaagcauaaaag

SEQ ID NO: 6872 - RNA, 21 nt, Artificial Sequence
  Synthetic construct
gagauccagauggagaagcga

SEQ ID NO: 6873 - RNA, 21 nt, Artificial Sequence
  Synthetic construct
cauacauuuccuccaauaguu

SEQ ID NO: 6874 - RNA, 21 nt, Artificial Sequence
  Synthetic construct
accacuguucccgcuguugca

SEQ ID NO: 6875 - RNA, 21 nt, Artificial Sequence
  Synthetic construct
cucaccaaguuucugaagcuc

SEQ ID NO: 6876 - RNA, 21 nt, Artificial Sequence
  Synthetic construct
aucucauugcaaauuucaucu

SEQ ID NO: 6877 - RNA, 21 nt, Artificial Sequence
  Synthetic construct
cuguucccgcuguugcaucug

SEQ ID NO: 6878 - RNA, 21 nt, Artificial Sequence
  Synthetic construct
gagaaacuacgacaucgucau

SEQ ID NO: 6879 - RNA, 21 nt, Artificial Sequence
  Synthetic construct
agcaccauguuguucugcagu

SEQ ID NO: 6880 - RNA, 21 nt, Artificial Sequence
  Synthetic construct
auacggacacaacccugaucu

SEQ ID NO: 6881 - RNA, 21 nt, Artificial Sequence
  Synthetic construct
aagagagcccagcaaugccac

SEQ ID NO: 6882 - RNA, 21 nt, Artificial Sequence
  Synthetic construct
cucgagucaacuugcugucac

SEQ ID NO: 6883 - RNA, 21 nt, Artificial Sequence
  Synthetic construct
aaggaugccugucccacuucu

SEQ ID NO: 6884 - RNA, 21 nt, Artificial Sequence
  Synthetic construct
uugcgacaugacggcaggggc

SEQ ID NO: 6885 - RNA, 21 nt, Artificial Sequence
  Synthetic construct
gagagguguuaauguuuccug

SEQ ID NO: 6886 - RNA, 21 nt, Artificial Sequence
  Synthetic construct
aaucauauaaguaaauaaaaa

SEQ ID NO: 6887 - RNA, 21 nt, Artificial Sequence
  Synthetic construct
caaucaugcaggaacggccuc

SEQ ID NO: 6888 - RNA, 21 nt, Artificial Sequence
  Synthetic construct
gggauucacauugacaaucau

SEQ ID NO: 6889 - RNA, 21 nt, Artificial Sequence
  Synthetic construct
agguucuugcguaccacagac

SEQ ID NO: 6890 - RNA, 21 nt, Artificial Sequence
  Synthetic construct
ucauuuccuccugucggaucu

SEQ ID NO: 6891 - RNA, 21 nt, Artificial Sequence
  Synthetic construct
caucccgcuccugaaucucuu

SEQ ID NO: 6892 - RNA, 21 nt, Artificial Sequence
  Synthetic construct
guucugcuuugaccgguucug

SEQ ID NO: 6893 - RNA, 21 nt, Artificial Sequence
  Synthetic construct
ugcuacauuuggaauucaaua

SEQ ID NO: 6894 - RNA, 21 nt, Artificial Sequence
  Synthetic construct
cuuguagaacaagggucucca

SEQ ID NO: 6895 - RNA, 21 nt, Artificial Sequence
  Synthetic construct
agguagagacgacagagcagu

SEQ ID NO: 6896 - RNA, 21 nt, Artificial Sequence
  Synthetic construct
ugcugucacggaagggaacca

SEQ ID NO: 6897 - RNA, 21 nt, Artificial Sequence
  Synthetic construct
cuuugaccgguucugcugguu

SEQ ID NO: 6898 - RNA, 21 nt, Artificial Sequence
  Synthetic construct
gaagaugcugugacugcggcu

SEQ ID NO: 6899 - RNA, 21 nt, Artificial Sequence
  Synthetic construct
caaguauacuuucaccuucuc

SEQ ID NO: 6900 - RNA, 21 nt, Artificial Sequence
  Synthetic construct
gggugcuuguagaacaagggu

SEQ ID NO: 6901 - RNA, 21 nt, Artificial Sequence
  Synthetic construct
caccuagucgccgaagcugga

SEQ ID NO: 6902 - RNA, 21 nt, Artificial Sequence
  Synthetic construct
agccgcaaagucugccucuug

SEQ ID NO: 6903 - RNA, 21 nt, Artificial Sequence
  Synthetic construct
gguaccuauccgacuuucgau

SEQ ID NO: 6904 - RNA, 21 nt, Artificial Sequence
  Synthetic construct
cgacuuucgauguagacacuc

SEQ ID NO: 6905 - RNA, 21 nt, Artificial Sequence
  Synthetic construct
gaugcugugacugcggcugga

SEQ ID NO: 6906 - RNA, 21 nt, Artificial Sequence
  Synthetic construct
cagacccugauugcugauggg

SEQ ID NO: 6907 - RNA, 21 nt, Artificial Sequence
  Synthetic construct
auacuuucaccuucuccauac

SEQ ID NO: 6908 - RNA, 21 nt, Artificial Sequence
  Synthetic construct
agggcuucagaucagguguug

SEQ ID NO: 6909 - RNA, 21 nt, Artificial Sequence
  Synthetic construct
agauccagauggagaagcgaa

SEQ ID NO: 6910 - RNA, 21 nt, Artificial Sequence
  Synthetic construct
acuugcugucacggaagggaa

SEQ ID NO: 6911 - RNA, 21 nt, Artificial Sequence
  Synthetic construct
agagguguuaauguuuccugc

SEQ ID NO: 6912 - RNA, 21 nt, Artificial Sequence
  Synthetic construct
gaaaccuuggaacacucgagu

SEQ ID NO: 6913 - RNA, 21 nt, Artificial Sequence
  Synthetic construct
caaagcucugguucuuacgac

SEQ ID NO: 6914 - RNA, 21 nt, Artificial Sequence
  Synthetic construct
cucauuggagagcaagggcuu

SEQ ID NO: 6915 - RNA, 21 nt, Artificial Sequence
  Synthetic construct
caucuugcacaugaauccagu

SEQ ID NO: 6916 - RNA, 21 nt, Artificial Sequence
  Synthetic construct
ugaguacauccuuuaccaucu

SEQ ID NO: 6917 - RNA, 21 nt, Artificial Sequence
  Synthetic construct
uguggacucaaacaugggaga

SEQ ID NO: 6918 - RNA, 21 nt, Artificial Sequence
  Synthetic construct
cugcugauuggagagacucac

SEQ ID NO: 6919 - RNA, 21 nt, Artificial Sequence
  Synthetic construct
acgacaucgucaucggacagc

SEQ ID NO: 6920 - RNA, 21 nt, Artificial Sequence
  Synthetic construct
caguucguuguagaucucaaa

SEQ ID NO: 6921 - RNA, 21 nt, Artificial Sequence
  Synthetic construct
cuccuugaggauauuuaguuu

SEQ ID NO: 6922 - RNA, 21 nt, Artificial Sequence
  Synthetic construct
gagaagcgaauguuugccggg

SEQ ID NO: 6923 - RNA, 21 nt, Artificial Sequence
  Synthetic construct
agaaaggaucccuugcgacau

SEQ ID NO: 6924 - RNA, 21 nt, Artificial Sequence
  Synthetic construct
cgacagagcagucugauagca

SEQ ID NO: 6925 - RNA, 21 nt, Artificial Sequence
  Synthetic construct
uguagacacuccucuucaagg

SEQ ID NO: 6926 - RNA, 21 nt, Artificial Sequence
  Synthetic construct
cgaaggaaugguuucuucccu

SEQ ID NO: 6927 - RNA, 21 nt, Artificial Sequence
  Synthetic construct
uggaggccuccauuuagcagg

SEQ ID NO: 6928 - RNA, 21 nt, Artificial Sequence
  Synthetic construct
auguuugccgggacagguagu

SEQ ID NO: 6929 - RNA, 21 nt, Artificial Sequence
  Synthetic construct
gaucacagagugacagcucgc

SEQ ID NO: 6930 - RNA, 21 nt, Artificial Sequence
  Synthetic construct
ccgcuccugaaucucuucuug

SEQ ID NO: 6931 - RNA, 21 nt, Artificial Sequence
  Synthetic construct
agcaauacagcggcccagggu

SEQ ID NO: 6932 - RNA, 21 nt, Artificial Sequence
  Synthetic construct
aaaggaucccuugcgacauga

SEQ ID NO: 6933 - RNA, 21 nt, Artificial Sequence
  Synthetic construct
ucacaguuagguugaagaagg

SEQ ID NO: 6934 - RNA, 21 nt, Artificial Sequence
  Synthetic construct
aguugagaucuuucacauagg

SEQ ID NO: 6935 - RNA, 21 nt, Artificial Sequence
  Synthetic construct
auugacaaucaugcaggaacg

SEQ ID NO: 6936 - RNA, 21 nt, Artificial Sequence
  Synthetic construct
cugauacuuaugcaacucuuc

SEQ ID NO: 6937 - RNA, 21 nt, Artificial Sequence
  Synthetic construct
acucuucagugguagaguuua

SEQ ID NO: 6938 - RNA, 21 nt, Artificial Sequence
  Synthetic construct
ccugauugagaagaugcugug

SEQ ID NO: 6939 - RNA, 21 nt, Artificial Sequence
  Synthetic construct
ugaauccaguugagaucuuuc

SEQ ID NO: 6940 - RNA, 21 nt, Artificial Sequence
  Synthetic construct
gcaagagagcuucuagcucuu

SEQ ID NO: 6941 - RNA, 21 nt, Artificial Sequence
  Synthetic construct
ccucaaguauacuuucaccuu

SEQ ID NO: 6942 - RNA, 21 nt, Artificial Sequence
  Synthetic construct
aagcucugguucuuacgaccc

SEQ ID NO: 6943 - RNA, 21 nt, Artificial Sequence
  Synthetic construct
gacugauagaagagagcccag

SEQ ID NO: 6944 - RNA, 21 nt, Artificial Sequence
  Synthetic construct
aaaucauauaaguaaauaaaa

SEQ ID NO: 6945 - RNA, 21 nt, Artificial Sequence
  Synthetic construct
cugguucuuacgacccacuuu

SEQ ID NO: 6946 - RNA, 21 nt, Artificial Sequence
  Synthetic construct
cgaagggcagcaauacagcgg

SEQ ID NO: 6947 - RNA, 21 nt, Artificial Sequence
  Synthetic construct
cuucacaguuagguugaagaa

SEQ ID NO: 6948 - RNA, 21 nt, Artificial Sequence
  Synthetic construct
agcagucugauagcagguucu

SEQ ID NO: 6949 - RNA, 21 nt, Artificial Sequence
  Synthetic construct
guagagacgacagagcagucu

SEQ ID NO: 6950 - RNA, 21 nt, Artificial Sequence
  Synthetic construct
ggaguuucaacacaguaugau

SEQ ID NO: 6951 - RNA, 21 nt, Artificial Sequence
  Synthetic construct
ugcccaucgaugacuuguuuc

SEQ ID NO: 6952 - RNA, 21 nt, Artificial Sequence
  Synthetic construct
uccacauucucaauacggaca

SEQ ID NO: 6953 - RNA, 21 nt, Artificial Sequence
  Synthetic construct
accugaagacuauguuccuug

SEQ ID NO: 6954 - RNA, 21 nt, Artificial Sequence
  Synthetic construct
ugucaucacaaguggucaagg

SEQ ID NO: 6955 - RNA, 21 nt, Artificial Sequence
  Synthetic construct
ccuuggaguuucaacacagua

SEQ ID NO: 6956 - RNA, 21 nt, Artificial Sequence
  Synthetic construct
cugaguauugcauccuggaua

SEQ ID NO: 6957 - RNA, 21 nt, Artificial Sequence
  Synthetic construct
cuuugaguacauccuuuacca

SEQ ID NO: 6958 - RNA, 21 nt, Artificial Sequence
  Synthetic construct
gugagcguaggauccgggcau

SEQ ID NO: 6959 - RNA, 21 nt, Artificial Sequence
  Synthetic construct
guacauccuuuaccaucuccu

SEQ ID NO: 6960 - RNA, 21 nt, Artificial Sequence
  Synthetic construct
cuucuuccgaagguccaguuu

SEQ ID NO: 6961 - RNA, 21 nt, Artificial Sequence
  Synthetic construct
gguaccuugaaucgugugggu

SEQ ID NO: 6962 - RNA, 21 nt, Artificial Sequence
  Synthetic construct
auccgggcauaagggcugcag

SEQ ID NO: 6963 - RNA, 21 nt, Artificial Sequence
  Synthetic construct
cuuggaguuucaacacaguau

SEQ ID NO: 6964 - RNA, 21 nt, Artificial Sequence
  Synthetic construct
aagguaacaagggccuaaccc

SEQ ID NO: 6965 - RNA, 21 nt, Artificial Sequence
  Synthetic construct
gugcugguaccuauccgacuu

SEQ ID NO: 6966 - RNA, 21 nt, Artificial Sequence
  Synthetic construct
uuaccucauuggagagcaagg

SEQ ID NO: 6967 - RNA, 21 nt, Artificial Sequence
  Synthetic construct
ugagauccagauggagaagcg

SEQ ID NO: 6968 - RNA, 21 nt, Artificial Sequence
  Synthetic construct
cuggaguucugguugaggugg

SEQ ID NO: 6969 - RNA, 21 nt, Artificial Sequence
  Synthetic construct
cagcuguggacucaaacaugg

SEQ ID NO: 6970 - RNA, 21 nt, Artificial Sequence
  Synthetic construct
cugaguuagugacuccauaug

SEQ ID NO: 6971 - RNA, 21 nt, Artificial Sequence
  Synthetic construct
accaucuccuucacaguuagg

SEQ ID NO: 6972 - RNA, 21 nt, Artificial Sequence
  Synthetic construct
gacuccauauguauagaugag

SEQ ID NO: 6973 - RNA, 21 nt, Artificial Sequence
  Synthetic construct
guuguugguuugguugcugau

SEQ ID NO: 6974 - RNA, 21 nt, Artificial Sequence
  Synthetic construct
gcaacaagcucucucugcuga

SEQ ID NO: 6975 - RNA, 21 nt, Artificial Sequence
  Synthetic construct
uuaucggcagcacugaagcuu

SEQ ID NO: 6976 - RNA, 21 nt, Artificial Sequence
  Synthetic construct
uguuccuucgucgucucccag

SEQ ID NO: 6977 - RNA, 21 nt, Artificial Sequence
  Synthetic construct
ucaauuuccaaacagucuccu

SEQ ID NO: 6978 - RNA, 21 nt, Artificial Sequence
  Synthetic construct
uuuccaaacagucuccuacau

SEQ ID NO: 6979 - RNA, 21 nt, Artificial Sequence
  Synthetic construct
uugacguacacccucucgccc

SEQ ID NO: 6980 - RNA, 21 nt, Artificial Sequence
  Synthetic construct
uuuaucggcagcacugaagcu

SEQ ID NO: 6981 - RNA, 21 nt, Artificial Sequence
  Synthetic construct
uucugaaacccaguccucccu

SEQ ID NO: 6982 - RNA, 21 nt, Artificial Sequence
  Synthetic construct
uaauagaggccguccugcggg

SEQ ID NO: 6983 - RNA, 21 nt, Artificial Sequence
  Synthetic construct
ucguguaccagagaggcccgu

SEQ ID NO: 6984 - RNA, 21 nt, Artificial Sequence
  Synthetic construct
uacagagagcugcgcagcgug

SEQ ID NO: 6985 - RNA, 21 nt, Artificial Sequence
  Synthetic construct
uccuucgucgucucccagccu

SEQ ID NO: 6986 - RNA, 21 nt, Artificial Sequence
  Synthetic construct
ucgagcagcagcucgggagug

SEQ ID NO: 6987 - RNA, 21 nt, Artificial Sequence
  Synthetic construct
ucugaaacccaguccucccug

SEQ ID NO: 6988 - RNA, 21 nt, Artificial Sequence
  Synthetic construct
uucacgcacucgcaccacgca

SEQ ID NO: 6989 - RNA, 21 nt, Artificial Sequence
  Synthetic construct
uuccaaacagucuccuacauu

SEQ ID NO: 6990 - RNA, 21 nt, Artificial Sequence
  Synthetic construct
aagaaggucuucccucucgcg

SEQ ID NO: 6991 - RNA, 21 nt, Artificial Sequence
  Synthetic construct
auauucacgcacucgcaccac

SEQ ID NO: 6992 - RNA, 21 nt, Artificial Sequence
  Synthetic construct
uccagcacuggagucaccguc

SEQ ID NO: 6993 - RNA, 21 nt, Artificial Sequence
  Synthetic construct
acugauguugacguacacccu

SEQ ID NO: 6994 - RNA, 21 nt, Artificial Sequence
  Synthetic construct
ucgcgaaguccaccauaucgg

SEQ ID NO: 6995 - RNA, 21 nt, Artificial Sequence
  Synthetic construct
uagccgacgagacaguagagg

SEQ ID NO: 6996 - RNA, 21 nt, Artificial Sequence
  Synthetic construct
ucacgcacucgcaccacgcac

SEQ ID NO: 6997 - RNA, 21 nt, Artificial Sequence
  Synthetic construct
aagcuuuccauucuuuauuuu

SEQ ID NO: 6998 - RNA, 21 nt, Artificial Sequence
  Synthetic construct
uaucggcagcacugaagcuuu

SEQ ID NO: 6999 - RNA, 21 nt, Artificial Sequence
  Synthetic construct
auguugacguacacccucucg

SEQ ID NO: 7000 - RNA, 21 nt, Artificial Sequence
  Synthetic construct
agaaggucuucccucucgcga

SEQ ID NO: 7001 - RNA, 21 nt, Artificial Sequence
  Synthetic construct
aacaaggucaccagagaagug

SEQ ID NO: 7002 - RNA, 21 nt, Artificial Sequence
  Synthetic construct
aacgccuguuccuucgucguc

SEQ ID NO: 7003 - RNA, 21 nt, Artificial Sequence
  Synthetic construct
ucgucucccagccuagccccu

SEQ ID NO: 7004 - RNA, 21 nt, Artificial Sequence
  Synthetic construct
ucggcguccgagaacugcguc

SEQ ID NO: 7005 - RNA, 21 nt, Artificial Sequence
  Synthetic construct
aauauucacgcacucgcacca

SEQ ID NO: 7006 - RNA, 21 nt, Artificial Sequence
  Synthetic construct
ucgucagaaacgccuguuccu

SEQ ID NO: 7007 - RNA, 21 nt, Artificial Sequence
  Synthetic construct
uaccagagaggcccguacccu

SEQ ID NO: 7008 - RNA, 21 nt, Artificial Sequence
  Synthetic construct
acuggagucaccgucucggcg

SEQ ID NO: 7009 - RNA, 21 nt, Artificial Sequence
  Synthetic construct
uaugaggugggcagcugggag

SEQ ID NO: 7010 - RNA, 21 nt, Artificial Sequence
  Synthetic construct
ugauguugacguacacccucu

SEQ ID NO: 7011 - RNA, 21 nt, Artificial Sequence
  Synthetic construct
aucaauuuccaaacagucucc

SEQ ID NO: 7012 - RNA, 21 nt, Artificial Sequence
  Synthetic construct
ugacguacacccucucgcccc

SEQ ID NO: 7013 - RNA, 21 nt, Artificial Sequence
  Synthetic construct
aguagagguaauagaggccgu

SEQ ID NO: 7014 - RNA, 21 nt, Artificial Sequence
  Synthetic construct
ugaagcuuuccauucuuuauu

SEQ ID NO: 7015 - RNA, 21 nt, Artificial Sequence
  Synthetic construct
cugauguugacguacacccuc

SEQ ID NO: 7016 - RNA, 21 nt, Artificial Sequence
  Synthetic construct
ucccgcucgucagaaacgccu

SEQ ID NO: 7017 - RNA, 21 nt, Artificial Sequence
  Synthetic construct
agcacuggagucaccgucucg

SEQ ID NO: 7018 - RNA, 21 nt, Artificial Sequence
  Synthetic construct
caauuuccaaacagucuccua

SEQ ID NO: 7019 - RNA, 21 nt, Artificial Sequence
  Synthetic construct
aaacgccuguuccuucgucgu

SEQ ID NO: 7020 - RNA, 21 nt, Artificial Sequence
  Synthetic construct
uauucacgcacucgcaccacg

SEQ ID NO: 7021 - RNA, 21 nt, Artificial Sequence
  Synthetic construct
auagaggccguccugcgggag

SEQ ID NO: 7022 - RNA, 21 nt, Artificial Sequence
  Synthetic construct
gacagugauaggcaccgccag

SEQ ID NO: 7023 - RNA, 21 nt, Artificial Sequence
  Synthetic construct
agcuucugaaacccaguccuc

SEQ ID NO: 7024 - RNA, 21 nt, Artificial Sequence
  Synthetic construct
agcaacaaggucaccagagaa

SEQ ID NO: 7025 - RNA, 21 nt, Artificial Sequence
  Synthetic construct
uuccuucgucgucucccagcc

SEQ ID NO: 7026 - RNA, 21 nt, Artificial Sequence
  Synthetic construct
uccgagaacugcgucccgcuc

SEQ ID NO: 7027 - RNA, 21 nt, Artificial Sequence
  Synthetic construct
agagcugcgcagcgugaccga

SEQ ID NO: 7028 - RNA, 21 nt, Artificial Sequence
  Synthetic construct
cugcgcagcgugaccgagcgg

SEQ ID NO: 7029 - RNA, 21 nt, Artificial Sequence
  Synthetic construct
aauagaggccguccugcggga

SEQ ID NO: 7030 - RNA, 21 nt, Artificial Sequence
  Synthetic construct
ugaaacccaguccucccugau

SEQ ID NO: 7031 - RNA, 21 nt, Artificial Sequence
  Synthetic construct
uguugacguacacccucucgc

SEQ ID NO: 7032 - RNA, 21 nt, Artificial Sequence
  Synthetic construct
acccaguccucccugauccug

SEQ ID NO: 7033 - RNA, 21 nt, Artificial Sequence
  Synthetic construct
acaaggucaccagagaagugg

SEQ ID NO: 7034 - RNA, 21 nt, Artificial Sequence
  Synthetic construct
uggagucaccgucucggcgcc

SEQ ID NO: 7035 - RNA, 21 nt, Artificial Sequence
  Synthetic construct
aucggcagcacugaagcuuuc

SEQ ID NO: 7036 - RNA, 21 nt, Artificial Sequence
  Synthetic construct
aauuuccaaacagucuccuac

SEQ ID NO: 7037 - RNA, 21 nt, Artificial Sequence
  Synthetic construct
agaaacgccuguuccuucguc

SEQ ID NO: 7038 - RNA, 21 nt, Artificial Sequence
  Synthetic construct
uucagcggagcgccuaugagg

SEQ ID NO: 7039 - RNA, 21 nt, Artificial Sequence
  Synthetic construct
ucaccgucucggcgcccucga

SEQ ID NO: 7040 - RNA, 21 nt, Artificial Sequence
  Synthetic construct
aacugcgucccgcucgucaga

SEQ ID NO: 7041 - RNA, 21 nt, Artificial Sequence
  Synthetic construct
auucacgcacucgcaccacgc

SEQ ID NO: 7042 - RNA, 21 nt, Artificial Sequence
  Synthetic construct
aaagaaggucuucccucucgc

SEQ ID NO: 7043 - RNA, 21 nt, Artificial Sequence
  Synthetic construct
guacagagagcugcgcagcgu

SEQ ID NO: 7044 - RNA, 21 nt, Artificial Sequence
  Synthetic construct
agacaguagagguaauagagg

SEQ ID NO: 7045 - RNA, 21 nt, Artificial Sequence
  Synthetic construct
caguagagguaauagaggccg

SEQ ID NO: 7046 - RNA, 21 nt, Artificial Sequence
  Synthetic construct
uccaaacagucuccuacauuu

SEQ ID NO: 7047 - RNA, 21 nt, Artificial Sequence
  Synthetic construct
caaacagucuccuacauuuuu

SEQ ID NO: 7048 - RNA, 21 nt, Artificial Sequence
  Synthetic construct
guaauagaggccguccugcgg

SEQ ID NO: 7049 - RNA, 21 nt, Artificial Sequence
  Synthetic construct
uucgucgucucccagccuagc

SEQ ID NO: 7050 - RNA, 21 nt, Artificial Sequence
  Synthetic construct
aaggucuucccucucgcgaag

SEQ ID NO: 7051 - RNA, 21 nt, Artificial Sequence
  Synthetic construct
cuguuccuucgucgucuccca

SEQ ID NO: 7052 - RNA, 21 nt, Artificial Sequence
  Synthetic construct
ccuucgucgucucccagccua

SEQ ID NO: 7053 - RNA, 21 nt, Artificial Sequence
  Synthetic construct
ugacugauguugacguacacc

SEQ ID NO: 7054 - RNA, 21 nt, Artificial Sequence
  Synthetic construct
ugcaccaggccgccgaacccc

SEQ ID NO: 7055 - RNA, 21 nt, Artificial Sequence
  Synthetic construct
gagguaauagaggccguccug

SEQ ID NO: 7056 - RNA, 21 nt, Artificial Sequence
  Synthetic construct
ucuucccucucgcgaagucca

SEQ ID NO: 7057 - RNA, 21 nt, Artificial Sequence
  Synthetic construct
agagguaauagaggccguccu

SEQ ID NO: 7058 - RNA, 21 nt, Artificial Sequence
  Synthetic construct
auuuccaaacagucuccuaca

SEQ ID NO: 7059 - RNA, 21 nt, Artificial Sequence
  Synthetic construct
acaguagagguaauagaggcc

SEQ ID NO: 7060 - RNA, 21 nt, Artificial Sequence
  Synthetic construct
cagcuucugaaacccaguccu

SEQ ID NO: 7061 - RNA, 21 nt, Artificial Sequence
  Synthetic construct
aacccaguccucccugauccu

SEQ ID NO: 7062 - RNA, 21 nt, Artificial Sequence
  Synthetic construct
uccggagcugcaccaggccgc

SEQ ID NO: 7063 - RNA, 21 nt, Artificial Sequence
  Synthetic construct
ucagaaacgccuguuccuucg

SEQ ID NO: 7064 - RNA, 21 nt, Artificial Sequence
  Synthetic construct
ucgucgucucccagccuagcc

SEQ ID NO: 7065 - RNA, 21 nt, Artificial Sequence
  Synthetic construct
cagcacuggagucaccgucuc

SEQ ID NO: 7066 - RNA, 21 nt, Artificial Sequence
  Synthetic construct
caguccucccugauccugggg

SEQ ID NO: 7067 - RNA, 21 nt, Artificial Sequence
  Synthetic construct
acugaagcuuuccauucuuua

SEQ ID NO: 7068 - RNA, 21 nt, Artificial Sequence
  Synthetic construct
ugcgcagcgugaccgagcggc

SEQ ID NO: 7069 - RNA, 21 nt, Artificial Sequence
  Synthetic construct
ucagcggagcgccuaugaggu

SEQ ID NO: 7070 - RNA, 21 nt, Artificial Sequence
  Synthetic construct
ucccucucgcgaaguccacca

SEQ ID NO: 7071 - RNA, 21 nt, Artificial Sequence
  Synthetic construct
agcacugaagcuuuccauucu

SEQ ID NO: 7072 - RNA, 21 nt, Artificial Sequence
  Synthetic construct
uagagguaauagaggccgucc

SEQ ID NO: 7073 - RNA, 21 nt, Artificial Sequence
  Synthetic construct
acucgcaccacgcacucauau

SEQ ID NO: 7074 - RNA, 21 nt, Artificial Sequence
  Synthetic construct
cucggcguccgagaacugcgu

SEQ ID NO: 7075 - RNA, 21 nt, Artificial Sequence
  Synthetic construct
aggacagugauaggcaccgcc

SEQ ID NO: 7076 - RNA, 21 nt, Artificial Sequence
  Synthetic construct
gcgaaguccaccauaucgggg

SEQ ID NO: 7077 - RNA, 21 nt, Artificial Sequence
  Synthetic construct
gagcugcgcagcgugaccgag

SEQ ID NO: 7078 - RNA, 21 nt, Artificial Sequence
  Synthetic construct
gagaacugcgucccgcucguc

SEQ ID NO: 7079 - RNA, 21 nt, Artificial Sequence
  Synthetic construct
acgcacucgcaccacgcacuc

SEQ ID NO: 7080 - RNA, 21 nt, Artificial Sequence
  Synthetic construct
gcacugaagcuuuccauucuu

SEQ ID NO: 7081 - RNA, 21 nt, Artificial Sequence
  Synthetic construct
acagcuagcaggagggaaccc

SEQ ID NO: 7082 - RNA, 21 nt, Artificial Sequence
  Synthetic construct
acgccuguuccuucgucgucu

SEQ ID NO: 7083 - RNA, 21 nt, Artificial Sequence
  Synthetic construct
caccacgcacucauauucccu

SEQ ID NO: 7084 - RNA, 21 nt, Artificial Sequence
  Synthetic construct
guagagguaauagaggccguc

SEQ ID NO: 7085 - RNA, 21 nt, Artificial Sequence
  Synthetic construct
acagagagcugcgcagcguga

SEQ ID NO: 7086 - RNA, 21 nt, Artificial Sequence
  Synthetic construct
gagacaguagagguaauagag

SEQ ID NO: 7087 - RNA, 21 nt, Artificial Sequence
  Synthetic construct
acugcgucccgcucgucagaa

SEQ ID NO: 7088 - RNA, 21 nt, Artificial Sequence
  Synthetic construct
cgcgaaguccaccauaucggg

SEQ ID NO: 7089 - RNA, 21 nt, Artificial Sequence
  Synthetic construct
guagccgacgagacaguagag

SEQ ID NO: 7090 - RNA, 21 nt, Artificial Sequence
  Synthetic construct
cacugaagcuuuccauucuuu

SEQ ID NO: 7091 - RNA, 21 nt, Artificial Sequence
  Synthetic construct
ucggcagcacugaagcuuucc

SEQ ID NO: 7092 - RNA, 19 nt, Artificial Sequence
  Synthetic construct
gcuacugcucaacucugaa

SEQ ID NO: 7093 - RNA, 19 nt, Artificial Sequence
  Synthetic construct
gcuucuauuacucccucaa

SEQ ID NO: 7094 - RNA, 19 nt, Artificial Sequence
  Synthetic construct
gacagaugccacugcagaa

SEQ ID NO: 7095 - RNA, 19 nt, Artificial Sequence
  Synthetic construct
cgacauugacugccucuaa

SEQ ID NO: 7096 - RNA, 19 nt, Artificial Sequence
  Synthetic construct
cacugauuauggacuucaa

SEQ ID NO: 7097 - DNA, 97 bp, Artificial Sequence
  Synthetic construct
tgctgttgacagtgagcgatagggactgaaggtctcaatatagtgaagccacagatgtatattgagaccttcagtccctactgcctactgcctcgga

SEQ ID NO: 7098 - DNA, 97 bp, Artificial Sequence
  Synthetic construct
tgctgttgacagtgagcgcagggactgaaggtctcaataatagtgaagccacagatgtattattgagaccttcagtccctatgcctactgcctcgga

SEQ ID NO: 7099 - DNA, 97 bp, Artificial Sequence
  Synthetic construct
tgctgttgacagtgagcgaaactggcttcatacacacaaatagtgaagccacagatgtatttgtgtgtatgaagccagttctgcctactgcctcgga

SEQ ID NO: 7100 - DNA, 97 bp, Artificial Sequence
  Synthetic construct
tgctgttgacagtgagcgccagtgtaataataacataatatagtgaagccacagatgtatattatgttattattacactgttgcctactgcctcgga

SEQ ID NO: 7101 - DNA, 97 bp, Artificial Sequence
  Synthetic construct
tgctgttgacagtgagcgacagaagagattcaatggctcatagtgaagccacagatgtatgagccattgaatctcttctggtgcctactgcctcgga

SEQ ID NO: 7102 - DNA, 97 bp, Artificial Sequence
  Synthetic construct
tgctgttgacagtgagcgcccgcggctggaatgactacaatagtgaagccacagatgtattgtagtcattccagccgcggatgcctactgcctcgga

SEQ ID NO: 7103 - DNA, 97 bp, Artificial Sequence
  Synthetic construct
tgctgttgacagtgagcgaaaggtgtgattctctgaggaatagtgaagccacagatgtattcctcagagaatcacaccttctgcctactgcctcgga

SEQ ID NO: 7104 - DNA, 97 bp, Artificial Sequence
  Synthetic construct
tgctgttgacagtgagcgccacattggtgttggacacatttagtgaagccacagatgtaaatgtgtccaacaccaatgtgatgcctactgcctcgga

SEQ ID NO: 7105 - DNA, 97 bp, Artificial Sequence
  Synthetic construct
tgctgttgacagtgagcgctccaggcagagtttgtgtctatagtgaagccacagatgtatagacacaaactctgcctggaatgcctactgcctcgga

SEQ ID NO: 7106 - DNA, 97 bp, Artificial Sequence
  Synthetic construct
tgctgttgacagtgagcgcaacagctgtgttcatcaacattagtgaagccacagatgtaatgttgatgaacacagctgttttgcctactgcctcgga

SEQ ID NO: 7107 - DNA, 97 bp, Artificial Sequence
  Synthetic construct
tgctgttgacagtgagcgccagctgtgttcatcaacatcatagtgaagccacagatgtatgatgttgatgaacacagctgttgcctactgcctcgga

SEQ ID NO: 7108 - DNA, 97 bp, Artificial Sequence
  Synthetic construct
tgctgttgacagtgagcgacatgtccttgttggcagctaatagtgaagccacagatgtattagctgccaacaaggacatggtgcctactgcctcgga

SEQ ID NO: 7109 - DNA, 97 bp, Artificial Sequence
  Synthetic construct
tgctgttgacagtgagcgaaagcagatgcttattttgttatagtgaagccacagatgtataacaaaataagcatctgcttctgcctactgcctcgga

SEQ ID NO: 7110 - DNA, 97 bp, Artificial Sequence
  Synthetic construct
tgctgttgacagtgagcgaccagctaattgtcattccatatagtgaagccacagatgtatatggaatgacaattagctgggtgcctactgcctcgga

SEQ ID NO: 7111 - DNA, 97 bp, Artificial Sequence
  Synthetic construct
tgctgttgacagtgagcgatccagtgtttgtgtatttatatagtgaagccacagatgtatataaatacacaaacactggagtgcctactgcctcgga

SEQ ID NO: 7112 - DNA, 97 bp, Artificial Sequence
  Synthetic construct
tgctgttgacagtgagcgcccagtgtttgtgtatttataatagtgaagccacagatgtattataaatacacaaacactggatgcctactgcctcgga

SEQ ID NO: 7113 - DNA, 97 bp, Artificial Sequence
  Synthetic construct
tgctgttgacagtgagcgacagcattgaccactacaagtatagtgaagccacagatgtatacttgtagtggtcaatgctggtgcctactgcctcgga

SEQ ID NO: 7114 - DNA, 97 bp, Artificial Sequence
  Synthetic construct
tgctgttgacagtgagcgatcctacaagatttcagcaatatagtgaagccacagatgtatattgctgaaatcttgtaggactgcctactgcctcgga

SEQ ID NO: 7115 - DNA, 97 bp, Artificial Sequence
  Synthetic construct
tgctgttgacagtgagcgaaaagccagaagctaccttctatagtgaagccacagatgtatagaaggtagcttctggctttctgcctactgcctcgga

SEQ ID NO: 7116 - DNA, 97 bp, Artificial Sequence
  Synthetic construct
tgctgttgacagtgagcgccagcagtttccttactgcagatagtgaagccacagatgtatctgcagtaaggaaactgctgatgcctactgcctcgga

SEQ ID NO: 7117 - DNA, 97 bp, Artificial Sequence
  Synthetic construct
tgctgttgacagtgagcgctccctcaaaattcaccaccaatagtgaagccacagatgtattggtggtgaattttgagggattgcctactgcctcgga

SEQ ID NO: 7118 - DNA, 97 bp, Artificial Sequence
  Synthetic construct
tgctgttgacagtgagcgccggctactgctcaactctgaatagtgaagccacagatgtattcagagttgagcagtagccgttgcctactgcctcgga

SEQ ID NO: 7119 - DNA, 97 bp, Artificial Sequence
  Synthetic construct
tgctgttgacagtgagcgacaagtggacggttttccagaatagtgaagccacagatgtattctggaaaaccgtccacttgctgcctactgcctcgga

SEQ ID NO: 7120 - DNA, 97 bp, Artificial Sequence
  Synthetic construct
tgctgttgacagtgagcgcaggcttctattactccctcaatagtgaagccacagatgtattgagggagtaatagaagcctttgcctactgcctcgga

SEQ ID NO: 7121 - DNA, 97 bp, Artificial Sequence
  Synthetic construct
tgctgttgacagtgagcgacccagcgaactcaagctgtaatagtgaagccacagatgtattacagcttgagttcgctgggctgcctactgcctcgga

SEQ ID NO: 7122 - DNA, 97 bp, Artificial Sequence
  Synthetic construct
tgctgttgacagtgagcgctgccaaaagcctgtaattctatagtgaagccacagatgtatagaattacaggcttttggcaatgcctactgcctcgga

SEQ ID NO: 7123 - DNA, 97 bp, Artificial Sequence
  Synthetic construct
tgctgttgacagtgagcgcaagcctgtaattctagcattatagtgaagccacagatgtataatgctagaattacaggcttttgcctactgcctcgga

SEQ ID NO: 7124 - DNA, 97 bp, Artificial Sequence
  Synthetic construct
tgctgttgacagtgagcgacagcaaggatttcttccagaatagtgaagccacagatgtattctggaagaaatccttgctgctgcctactgcctcgga

SEQ ID NO: 7125 - DNA, 97 bp, Artificial Sequence
  Synthetic construct
tgctgttgacagtgagcgactgacagatgccactgcagaatagtgaagccacagatgtattctgcagtggcatctgtcaggtgcctactgcctcgga

SEQ ID NO: 7126 - DNA, 97 bp, Artificial Sequence
  Synthetic construct
tgctgttgacagtgagcgccagcagaggagatgtggtaaatagtgaagccacagatgtatttaccacatctcctctgctgatgcctactgcctcgga

SEQ ID NO: 7127 - DNA, 97 bp, Artificial Sequence; identical to SEQ ID NO: 7124
  Synthetic construct

SEQ ID NO: 7128 - DNA, 97 bp, Artificial Sequence
  Synthetic construct
tgctgttgacagtgagcgcgcccagcgaactcaagctgtatagtgaagccacagatgtatacagcttgagttcgctgggcatgcctactgcctcgga

SEQ ID NO: 7129 - DNA, 97 bp, Artificial Sequence; identical to SEQ ID NO: 7121
  Synthetic construct

SEQ ID NO: 7130 - DNA, 97 bp, Artificial Sequence
  Synthetic construct
tgctgttgacagtgagcgccacgacattgactgcctctaatagtgaagccacagatgtattagaggcagtcaatgtcgtgatgcctactgcctcgga

SEQ ID NO: 7131 - DNA, 97 bp, Artificial Sequence
  Synthetic construct
tgctgttgacagtgagcgcgccatccatacactcaaaaaatagtgaagccacagatgtattttttgagtgtatggatggcatgcctactgcctcgga

SEQ ID NO: 7132 - DNA, 97 bp, Artificial Sequence
  Synthetic construct
tgctgttgacagtgagcgcgacgccatagttgccaccttatagtgaagccacagatgtataaggtggcaactatggcgtcttgcctactgcctcgga

SEQ ID NO: 7133 - DNA, 97 bp, Artificial Sequence
  Synthetic construct
tgctgttgacagtgagcgcgaggcagatgcttactttgtatagtgaagccacagatgtatacaaagtaagcatctgcctcatgcctactgcctcgga

SEQ ID NO: 7134 - DNA, 97 bp, Artificial Sequence
  Synthetic construct
tgctgttgacagtgagcgaccagataaagttattcaagtatagtgaagccacagatgtatacttgaataactttatctggctgcctactgcctcgga

SEQ ID NO: 7135 - DNA, 97 bp, Artificial Sequence
  Synthetic construct
tgctgttgacagtgagcgacagataaagttattcaagtaatagtgaagccacagatgtattacttgaataactttatctggtgcctactgcctcgga

SEQ ID NO: 7136 - DNA, 97 bp, Artificial Sequence
  Synthetic construct
tgctgttgacagtgagcgctggattgtcaccgaagacatatagtgaagccacagatgtatatgtcttcggtgacaatccattgcctactgcctcgga

SEQ ID NO: 7137 - DNA, 97 bp, Artificial Sequence
  Synthetic construct
tgctgttgacagtgagcgcaagctggtatttgaatactaatagtgaagccacagatgtattagtattcaaataccagcttttgcctactgcctcgga

SEQ ID NO: 7138 - DNA, 97 bp, Artificial Sequence
  Synthetic construct
tgctgttgacagtgagcgcaccactgattatggacttcaatagtgaagccacagatgtattgaagtccataatcagtggtttgcctactgcctcgga

SEQ ID NO: 7139 - DNA, 97 bp, Artificial Sequence; identical to SEQ ID NO: 7130
  Synthetic construct

SEQ ID NO: 7140 - DNA, 97 bp, Artificial Sequence; identical to SEQ ID NO: 7138
  Synthetic construct

SEQ ID NO: 7141 - DNA, 21 bp, Artificial Sequence
  Synthetic construct
uucagaguugagcaguagccg

SEQ ID NO: 7142 - DNA, 21 bp, Artificial Sequence
  Synthetic construct
uugagggaguaauagaagccu

SEQ ID NO: 7143 - DNA, 21 bp, Artificial Sequence
  Synthetic construct
uucugcaguggcaucugucag

SEQ ID NO: 7144 - DNA, 21 bp, Artificial Sequence
  Synthetic construct
uuagaggcagucaaugucgug

SEQ ID NO: 7145 - DNA, 21 bp, Artificial Sequence
  Synthetic construct
uugaaguccauaaucaguggu

SEQ ID NO: 7146 - DNA, 22 bp, Artificial Sequence
  synthetic construct
ccagcuacugcucaacucugaa

SEQ ID NO: 7147 - DNA, 22 bp, Artificial Sequence
  synthetic construct
ccagcuucuauuacucccucaa

SEQ ID NO: 7148 - DNA, 22 bp, Artificial Sequence
  synthetic construct
ccagacagaugccacugcagaa

SEQ ID NO: 7149 - DNA, 22 bp, Artificial Sequence
  synthetic construct
ccacgacauugacugccucuaa

SEQ ID NO: 7150 - DNA, 22 bp, Artificial Sequence
  synthetic construct
ccacacugauuauggacuucaa

SEQ ID NO: 7151 - DNA, 21 bp, Artificial Sequence
  synthetic construct
uucagaguugagcaguagctt

SEQ ID NO: 7152 - DNA, 21 bp, Artificial Sequence
  synthetic construct
uugagggaguaauagaagctt

SEQ ID NO: 7153 - DNA, 21 bp, Artificial Sequence
  synthetic construct
uucugcaguggcaucuguctt

SEQ ID NO: 7154 - DNA, 21 bp, Artificial Sequence
  synthetic construct
uuagaggcagucaaugucgtt

SEQ ID NO: 7155 - DNA, 21 bp, Artificial Sequence
  synthetic construct
uugaaguccauaaucagugtt

SEQ ID NO: 7156 - protein, 255 aa, Homo sapiens
MKALLALPLLLLLSTPPCAPQVSGIRGDALERFCLQQPLDCDDIYAQGYQSDGVYLIYPSGPSVPVPVFCDMTTEGGKWTVFQKRFNGSVSFFRGWNDYKLGFGRADGEYWLGLQNMHLLTLKQKYELRVDLEDFENNTAYAKYADFSISPNAVSAEEDGYTLFVAGFEDGGAGDSLSYHSGQKFSTFDRDQDLFVQNCAALSSGAFWFRSCHFANLNGFYLGGSHLSYANGINWAQWKGFYYSLKRTEMKIRRA

SEQ ID NO: 7157 - protein, 279 aa, Homo sapiens
MGELSPLQRPLATEGTMKAQGVLLKLALLALPLLLLLSTPPCAPQVSGIRGDALERFCLQQPLDCDDIYAQGYQSDGVYLIYPSGPSVPVPVFCDMTTEGGKWTVFQKRFNGSVSFFRGWNDYKLGFGRADGEYWLGLQNMHLLTLKQKYELRVDLEDFENNTAYAKYADFSISPNAVSAEEDGYTLFVAGFEDGGAGDSLSYHSGQKFSTFDRDQDLFVQNCAALSSGAFWFRSCHFANLNGFYLGGSHLSYANGINWAQWKGFYYSLKRTEMKIRRA

SEQ ID NO: 7158 - protein, 328 aa, Homo sapiens
MRPVRLMKVFVTRRIPAEGRVALARAADCEVEQWDSDEPIPAKELERGVAGAHGLLCLLSDHVDKRILDAAGANLKVISTMSVGIDHLALDEIKKRGIRVGYTPDVLTDTTAELAVSLLLTTCRRLPEAIEEVKNGGWTSWKPLWLCGYGLTQSTVGIIGLGRIGQAIARRLKPFGVQRFLYTGRQPRPEEAAEFQAEFVSTPELAAQSDFIVVACSLTPATEGLCNKDFFQKMKETAVFINISRGDVVNQDDLYQALASGKIAAAGLDVTSPEPLPTNHPLLTLKNCVILPHIGSATHRTRNTMSLLAANNLLAGLRGEPMPSELKL

SEQ ID NO: 7159 - protein, 252 aa, Homo sapiens
MLGGVPTLCGTGNETWTLLALGQAIARRLKPFGVQRFLYTGRQPRPEEAAEFQAEFVSTPELAAQSDFIVVACSLTPATEGLCNKDFFQKMKETAVFINISRYPRATLPSKPGEEPSPLLPSGDFLPRGLLVRPQAELAGFHKPNNQLRNSWEYTRPPYREEEPSEWAWPVCFSAVAPTRRGLAHSSVASGSVPREPLQAHYPPPQRAGLEDLKGPLEAASHTAEPGFVWLWFSDTLNLMLLGGQTLKLTWS

SEQ ID NO: 7160 - protein, 612 aa, Homo sapiens
MAAAGRLPSSWALFSPLLAGLALLGVGPVPARALHNVTAELFGAEAWGTLAAFGDLNSDKQTDLFVLRERNDLIVFLADQNAPYFKPKVKVSFKNHSALITSVVPGDYDGDSQMDVLLTYLPKNYAKSELGAVIFWGQNQTLDPNNMTILNRTFQDEPLIMDFNGDLIPDIFGITNESNQPQILLGGNLSWHPALTTTSKMRIPHSHAFIDLTEDFTADLFLTTLNATTSTFQFEIWENLDGNFSVSTILEKPQNMMVVGQSAFADFDGDGHMDHLLPGCEDKNCQKSTIYLVRSGMKQWVPVLQDFSNKGTLWGFVPFVDEQQPTEIPIPITLHIGDYNMDGYPDALVILKNTSGSNQQAFLLENVPCNNASCEEARRMFKVYWELTDLNQIKDAMVATFFDIYEDGILDIVVLSKGYTKNDFAIHTLKNNFEADAYFVKVIVLSGLCSNDCPRKITPFGVNQPGPYIMYTTVDANGYLKNGSAGQLSQSAHLALQLPYNVLGLGRSANFLDHLYVGIPRPSGEKSIRKQEWTAIIPNSQLIVIPYPHNVPRSWSAKLYLTPSNIVLLTAIALIGVCVFILAIIGILHWQEKKADDREKRQEAHRFHFDAM

SEQ ID NO: 7161 - protein, 1325 aa, Homo sapiens
MLPVYQEVKPNPLQDANLCSRVFFWWLNPLFKIGHKRRLEEDDMYSVLPEDRSQHLGEELQGFWDKEVLRAENDAQKPSLTRAIIKCYWKSYLVLGIFTLIEESAKVIQPIFLGKIINYFENYDPMDSVALNTAYAYATVLTFCTLILAILHHLYFYHVQCAGMRLRVAMCHMIYRKALRLSNMAMGKTTTGQIVNLLSNDVNKFDQVTVFLHFLWAGPLQAIAVTALLWMEIGISCLAGMAVLIILLPLQSCFGKLFSSLRSKTATFTDARIRTMNEVITGIRIIKMYAWEKSFSNLITNLRKKEISKILRSSCLRGMNLASFFSASKIIVFVTFTTYVLLGSVITASRVFVAVTLYGAVRLTVTLFFPSAIERVSEAIVSIRRIQTFLLLDEISQRNRQLPSDGKKMVHVQDFTAFWDKASETPTLQGLSFTVRPGELLAVVGPVGAGKSSLLSAVLGELAPSHGLVSVHGRIAYVSQQPWVFSGTLRSNILFGKKYEKERYEKVIKACALKKDLQLLEDGDLTVIGDRGTTLSGGQKARVNLARAVYQDADIYLLDDPLSAVDAEVSRHLFELCICQILHEKITILVTHQLQYLKAASQILILKDGKMVQKGTYTEFLKSGIDFGSLLKKDNEESEQPPVPGTPTLRNRTFSESSVWSQQSSRPSLKDGALESQDTENVPVTLSEENRSEGKVGFQAYKNYFRAGAHWIVFIFLILLNTAAQVAYVLQDWWLSYWANKQSMLNVTVNGGGNVTEKLDLNWYLGIYSGLTVATVLFGIARSLLVFYVLVNSSQTLHNKMFESILKAPVLFFDRNPIGRILNRFSKDIGHLDDLLPLTFLDFIQTLLQVVGVVSVAVAVIPWIAIPLVPLGIIFIFLRRYFLETSRDVKRLESTTRSPVFSHLSSSLQGLWTIRAYKAEERCQELFDAHQDLHSEAWFLFLTTSRWFAVRLDAICAMFVIIVAFGSLILAKTLDAGQVGLALSYALTLMGMFQWCVRQSAEVENMMISVERVIEYTDLEKEAPWEYQKRPPPAWPHEGVIIFDNVNFMYSPGGPLVLKHLTALIKSQEKVGIVGRTGAGKSSLISALFRLSEPEGKIWIDKILTTEIGLHDLRKKMSIIPQEPVLFTGTMRKNLDPFNEHTDEELWNALQEVQLKETIEDLPGKMDTELAESGSNFSVGQRQLVCLARAILRKNQILIIDEATANVDPRTDELIQKKIREKFAHCTVLTIAHRLNTIIDSDKIMVLDSGRLKEYDEPYVLLQNKESLFYKMVQQLGKAEAAALTETAKQVYFKRNYPHIGHTDHMVTNTSNGQPSTLTIFETAL

SEQ ID NO: 7162 - protein, 1278 aa, Homo sapiens
MLPVYQEVKPNPLQDANLCSRVFFWWLNPLFKIGHKRRLEEDDMYSVLPEDRSQHLGEELQGFWDKEVLRAENDAQKPSLTRAIIKCYWKSYLVLGIFTLIEESAKVIQPIFLGKIINYFENYDPMDSVALNTAYAYATVLTFCTLILAILHHLYFYHVQCAGMRLRVAMCHMIYRKALRLSNMAMGKTTTGQIVNLLSNDVNKFDQVTVFLHFLWAGPLQAIAVTALLWMEIGISCLAGMAVLIILLPLQSCFGKLFSSLRSKTATFTDARIRTMNEVITGIRIIKMYAWEKSFSNLITNLRKKEISKILRSSCLRGMNLASFFSASKIIVFVTFTTYVLLGSVITASRVFVAVTLYGAVRLTVTLFFPSAIERVSEAIVSIRRIQTFLLLDEISQRNRQLPSDGKKMVHVQDFTAFWDKASETPTLQGLSFTVRPGELLAVVGPVGAGKSSLLSAVLGELAPSHGLVSVHGRIAYVSQQPWVFSGTLRSNILFGKKYEKERYEKVIKACALKKDLQLLEDGDLTVIGDRGTTLSGGQKARVNLARAVYQDADIYLLDDPLSAVDAEVSRHLFELCICQILHEKITILVTHQLQYLKAASQILILKDGKMVQKGTYTEFLKSGIDFGSLLKKDNEESEQPPVPGTPTLRNRTFSESSVWSQQSSRPSLKDGALESQDVAYVLQDWWLSYWANKQSMLNVTVNGGGNVTEKLDLNWYLGIYSGLTVATVLFGIARSLLVFYVLVNSSQTLHNKMFESILKAPVLFFDRNPIGRILNRFSKDIGHLDDLLPLTFLDFIQTLLQVVGVVSVAVAVIPWIAIPLVPLGIIFIFLRRYFLETSRDVKRLESTTRSPVFSHLSSSLQGLWTIRAYKAEERCQELFDAHQDLHSEAWFLFLTTSRWFAVRLDAICAMFVIIVAFGSLILAKTLDAGQVGLALSYALTLMGMFQWCVRQSAEVENMMISVERVIEYTDLEKEAPWEYQKRPPPAWPHEGVIIFDNVNFMYSPGGPLVLKHLTALIKSQEKVGIVGRTGAGKSSLISALFRLSEPEGKIWIDKILTTEIGLHDLRKKMSIIPQEPVLFTGTMRKNLDPFNEHTDEELWNALQEVQLKETIEDLPGKMDTELAESGSNFSVGQRQLVCLARAILRKNQILIIDEATANVDPRTDELIQKKIREKFAHCTVLTIAHRLNTIIDSDKIMVLDSGRLKEYDEPYVLLQNKESLFYKMVQQLGKAEAAALTETAKQVYFKRNYPHIGHTDHMVTNTSNGQPSTLTIFETAL

SEQ ID NO: 7163 - protein, 859 aa, Homo sapiens
MLPVYQEVKPNPLQDANLCSRVFFWWLNPLFKIGHKRRLEEDDMYSVLPEDRSQHLGEELQGFWDKEVLRAENDAQKPSLTRAIIKCYWKSYLVLGIFTLIEESAKVIQPIFLGKIINYFENYDPMDSVALNTAYAYATVLTFCTLILAILHHLYFYHVQCAGMRLRVAMCHMIYRKALRLSNMAMGKTTTGQIVNLLSNDVNKFDQVTVFLHFLWAGPLQAIAVTALLWMEIGISCLAGMAVLIILLPLQSCFGKLFSSLRSKTATFTDARIRTMNEVITGIRIIKMYAWEKSFSNLITNLRKKEISKILRSSCLRGMNLASFFSASKIIVFVTFTTYVLLGSVITASRVFVAVTLYGAVRLTVTLFFPSAIERVSEAIVSIRRIQTFLLLDEISQRNRQLPSDGKKMVHVQDFTAFWDKASETPTLQGLSFTVRPGELLAVVGPVGAGKSSLLSAVLGELAPSHGLVSVHGRIAYVSQQPWVFSGTLRSNILFGKKYEKERYEKVIKACALKKDLQLLEDGDLTVIGDRGTTLSGGQKARVNLARAVYQDADIYLLDDPLSAVDAEVSRHLFELCICQILHEKITILVTHQLQYLKAASQILILKDGKMVQKGTYTEFLKSGIDFGSLLKKDNEESEQPPVPGTPTLRNRTFSESSVWSQQSSRPSLKDGALESQDTENVPVTLSEENRSEGKVGFQAYKNYFRAGAHWIVFIFLILLNTAAQVAYVLQDWWLSYWANKQSMLNVTVNGGGNVTEKLDLNWYLGIYSGLTVATVLFGIARSLLVFYVLVNSSQTLHNKMFESILKAPVLFFDRNPIGRILNRFSKDIGHLDDLLPLTFLDFIQRWDLAVLSWLVSNS

SEQ ID NO: 7164 - protein, 784 aa, Homo sapiens
MLPVYQEVKPNPLQDANLCSRVFFWWLNPLFKIGHKRRLEEDDMYSVLPEDRSQHLGEELQGFWDKEVLRAENDAQKPSLTRAIIKCYWKSYLVLGIFTLIEALRLSNMAMGKTTTGQIVNLLSNDVNKFDQVTVFLHFLWAGPLQAIAVTALLWMEIGISCLAGMAVLIILLPLQSCFGKLFSSLRSKTATFTDARIRTMNEVITGIRIIKMYAWEKSFSNLITNLRKKEISKILRSSCLRGMNLASFFSASKIIVFVTFTTYVLLGSVITASRVFVAVTLYGAVRLTVTLFFPSAIERVSEAIVSIRRIQTFLLLDEISQRNRQLPSDGKKMVHVQDFTAFWDKASETPTLQGLSFTVRPGELLAVVGPVGAGKSSLLSAVLGELAPSHGLVSVHGRIAYVSQQPWVFSGTLRSNILFGKKYEKERYEKVIKACALKKDLQLLEDGDLTVIGDRGTTLSGGQKARVNLARAVYQDADIYLLDDPLSAVDAEVSRHLFELCICQILHEKITILVTHQLQYLKAASQILILKDGKMVQKGTYTEFLKSGIDFGSLLKKDNEESEQPPVPGTPTLRNRTFSESSVWSQQSSRPSLKDGALESQDTENVPVTLSEENRSEGKVGFQAYKNYFRAGAHWIVFIFLILLNTAAQVAYVLQDWWLSYWANKQSMLNVTVNGGGNVTEKLDLNWYLGIYSGLTVATVLFGIARSLLVFYVLVNSSQTLHNKMFESILKAPVLFFDRNPIGRILNRFSKDIGHLDDLLPLTFLDFIQRWDLAVLSWLVSNS

SEQ ID NO: 7165 - protein, 559 aa, Homo sapiens
MSDGLDNEEKPPAPPLRMNSNNRDSSALNHSSKPLPMAPEEKNKKARLRSIFPGGGDKTNKKKEKERPEISLPSDFEHTIHVGFDAVTGEFTPDLYGSQMCPGKLPEGIPEQWARLLQTSNITKLEQKKNPQAVLDVLKFYDSKETVNNQKYMSFTSGDKSAHGYIAAHPSSTKTASEPPLAPPVSEEEDEEEEEEEDENEPPPVIAPRPEHTKSIYTRSVVESIASPAVPNKEVTPPSAENANSSTLYRNTDRQRKKSKMTDEEILEKLRSIVSVGDPKKKYTRFEKIGQGASGTVYTALDIATGQEVAIKQMNLQQQPKKELIINEILVMRENKNPNIVNYLDSYLVGDELWVVMEYLAGGSLTDVVTETCMDEGQIAAVCRECLQALDFLHSNQVIHRDIKSDNILLGMDGSVKLTDFGFCAQITPEQSKRSTMVGTPYWMAPEVVTRKAYGPKVDIWSLGIMAIEMVEGEPPYLNENPLRALYLIATNGTPELQNPERLSAVFRDFLNRCLEMDVDRRGSAKELLQHPFLKLAKPLSSLTPLIIAAKEAIKNSSR

SEQ ID NO: 7166 - protein, 544 aa, Homo sapiens
MSDGLDNEEKPPAPPLRMNSNNRDSSALNHSSKPLPMAPEEKNKKARLRSIFPGGGDKTNKKKEKERPEISLPSDFEHTIHVGFDAVTGEFTGIPEQWARLLQTSNITKLEQKKNPQAVLDVLKFYDSKETVNNQKYMSFTSGDKSAHGYIAAHPSSTKTASEPPLAPPVSEEEDEEEEEEEDENEPPPVIAPRPEHTKSIYTRSVVESIASPAVPNKEVTPPSAENANSSTLYRNTDRQRKKSKMTDEEILEKLRSIVSVGDPKKKYTRFEKIGQGASGTVYTALDIATGQEVAIKQMNLQQQPKKELIINEILVMRENKNPNIVNYLDSYLVGDELWVVMEYLAGGSLTDVVTETCMDEGQIAAVCRECLQALDFLHSNQVIHRDIKSDNILLGMDGSVKLTDFGFCAQITPEQSKRSTMVGTPYWMAPEVVTRKAYGPKVDIWSLGIMAIEMVEGEPPYLNENPLRALYLIATNGTPELQNPERLSAVFRDFLNRCLEMDVDRRGSAKELLQHPFLKLAKPLSSLTPLIIAAKEAIKNSSR

SEQ ID NO: 7167 - protein, 580 aa, Homo sapiens
MSDGLDNEEKPPAPPLRMNSNNRDSSALNHSSKPLPMAPEEKNKKARLRSIFPGGGDKTNKKKEKERPEISLPSDFEHTIHVGFDAVTGEFTNSPFQTSRPVTVASSQSEGKMPDLYGSQMCPGKLPEGIPEQWARLLQTSNITKLEQKKNPQAVLDVLKFYDSKETVNNQKYMSFTSGDKSAHGYIAAHPSSTKTASEPPLAPPVSEEEDEEEEEEEDENEPPPVIAPRPEHTKSIYTRSVVESIASPAVPNKEVTPPSAENANSSTLYRNTDRQRKKSKMTDEEILEKLRSIVSVGDPKKKYTRFEKIGQGASGTVYTALDIATGQEVAIKQMNLQQQPKKELIINEILVMRENKNPNIVNYLDSYLVGDELWVVMEYLAGGSLTDVVTETCMDEGQIAAVCRECLQALDFLHSNQVIHRDIKSDNILLGMDGSVKLTDFGFCAQITPEQSKRSTMVGTPYWMAPEVVTRKAYGPKVDIWSLGIMAIEMVEGEPPYLNENPLRALYLIATNGTPELQNPERLSAVFRDFLNRCLEMDVDRRGSAKELLQHPFLKLAKPLSSLTPLIIAAKEAIKNSSR

SEQ ID NO: 7168 - protein, 565 aa, Homo sapiens
MSDGLDNEEKPPAPPLRMNSNNRDSSALNHSSKPLPMAPEEKNKKARLRSIFPGGGDKTNKKKEKERPEISLPSDFEHTIHVGFDAVTGEFTNSPFQTSRPVTVASSQSEGKMGIPEQWARLLQTSNITKLEQKKNPQAVLDVLKFYDSKETVNNQKYMSFTSGDKSAHGYIAAHPSSTKTASEPPLAPPVSEEEDEEEEEEEDENEPPPVIAPRPEHTKSIYTRSVVESIASPAVPNKEVTPPSAENANSSTLYRNTDRQRKKSKMTDEEILEKLRSIVSVGDPKKKYTRFEKIGQGASGTVYTALDIATGQEVAIKQMNLQQQPKKELIINEILVMRENKNPNIVNYLDSYLVGDELWVVMEYLAGGSLTDVVTETCMDEGQIAAVCRECLQALDFLHSNQVIHRDIKSDNILLGMDGSVKLTDFGFCAQITPEQSKRSTMVGTPYWMAPEVVTRKAYGPKVDIWSLGIMAIEMVEGEPPYLNENPLRALYLIATNGTPELQNPERLSAVFRDFLNRCLEMDVDRRGSAKELLQHPFLKLAKPLSSLTPLIIAAKEAIKNSSR

SEQ ID NO: 7169 - protein, 227 aa, Homo sapiens
MPGCRISACGPGAQEGTAEQRSPPPPWDPMPSSQPPPPTPTLTPTPTPGQSPPLPDAAGASAGAAEDQELQRWRQGASGIAGLAGPGGGSGAAAGAGGRALELAEARRRLLEVEGRRRLVSELESRVLQLHRVFLAAELRLAHRAESLSRLSGGVAQAELYLAAHGSRLKKGPRRGRRGRPPALLASALGLGGCVPWGAGRLRRGHGPEPDSPFRRSPPRGPASPQR

SEQ ID NO: 7170 - protein, 77 aa, Homo sapiens
MNLRLCVQALLLLWLSLTAVCGGSLMPLPDGNGLEDGNVRHLVQPRGSRNGPGPWQGGRRKFRRQRPRLSHKGPMPF

SEQ ID NO: 7171 - protein, 36 aa, Artificial Sequence
  synthetic construct
LVQPRGSRNGPGPWQGGRRKFRRQRPRLSHKGPMPF

SEQ ID NO: 7172 - protein, 31 aa, Artificial Sequence
  synthetic construct
GSRNGPGPWQGGRRKFRRQRPRLSHKGPMPF

SEQ ID NO: 7173 - protein, 28 aa, Artificial Sequence
  synthetic construct
NGPGPWQGGRRKFRRQRPRLSHKGPMPF

SEQ ID NO: 7174 - protein, 13 aa, Artificial Sequence
  synthetic construct
QRPRLSHKGPMPF

SEQ ID NO: 7175 - protein, 890 aa, Homo sapiens
MSQGILSPPAGLLSDDDVVVSPMFESTAADLGSVVRKNLLSDCSVVSTSLEDKQQVPSEDSMEKVKVYLRVRPLLPSELERQEDQGCVRIENVETLVLQAPKDSFALKSNERGIGQATHRFTFSQIFGPEVGQASFFNLTVKEMVKDVLKGQNWLIYTYGVTNSGKTHTIQGTIKDGGILPRSLALIFNSLQGQLHPTPDLKPLLSNEVIWLDSKQIRQEEMKKLSLLNGGLQEEELSTSLKRSVYIESRIGTSTSFDSGIAGLSSISQCTSSSQLDETSHRWAQPDTAPLPVPANIRFSIWISFFEIYNELLYDLLEPPSQQRKRQTLRLCEDQNGNPYVKDLNWIHVQDAEEAWKLLKVGRKNQSFASTHLNQNSSRSHSIFSIRILHLQGEGDIVPKISELSLCDLAGSERCKDQKSGERLKEAGNINTSLHTLGRCIAALRQNQQNRSKQNLVPFRDSKLTRVFQGFFTGRGRSCMIVNVNPCASTYDETLHVAKFSAIASQLVHAPPMQLGFPSLHSFIKEHSLQVSPSLEKGAKADTGLDDDIENEADISMYGKEELLQVVEAMKTLLLKERQEKLQLEMHLRDEICNEMVEQMQQREQWCSEHLDTQKELLEEMYEEKLNILKESLTSFYQEEIQERDEKIEELEALLQEARQQSVAHQQSGSELALRRSQRLAASASTQQLQEVKAKLQQCKAELNSTTEELHKYQKMLEPPPSAKPFTIDVDKKLEEGQKNIRLLRTELQKLGESLQSAERACCHSTGAGKLRQALTTCDDILIKQDQTLAELQNNMVLVKLDLRKKAACIAEQYHTVLKLQGQVSAKKRLGTNQENQQPNQQPPGKKPFLRNLLPRTPTCQSSTDCSPYARILRSRRSPLLKSGPFGKKY

SEQ ID NO: 7176 - protein, 872 aa, Homo sapiens
MSQGILSPPAGLLSDDDVVVSPMFESTAADLGSVVRKNLLSDCSVVSTSLEDKQQVPSEDSMEKEDQGCVRIENVETLVLQAPKDSFALKSNERGIGQATHRFTFSQIFGPEVGQASFFNLTVKEMVKDVLKGQNWLIYTYGVTNSGKTHTIQGTIKDGGILPRSLALIFNSLQGQLHPTPDLKPLLSNEVIWLDSKQIRQEEMKKLSLLNGGLQEEELSTSLKRSVYIESRIGTSTSFDSGIAGLSSISQCTSSSQLDETSHRWAQPDTAPLPVPANIRFSIWISFFEIYNELLYDLLEPPSQQRKRQTLRLCEDQNGNPYVKDLNWIHVQDAEEAWKLLKVGRKNQSFASTHLNQNSSRSHSIFSIRILHLQGEGDIVPKISELSLCDLAGSERCKDQKSGERLKEAGNINTSLHTLGRCIAALRQNQQNRSKQNLVPFRDSKLTRVFQGFFTGRGRSCMIVNVNPCASTYDETLHVAKFSAIASQLVHAPPMQLGFPSLHSFIKEHSLQVSPSLEKGAKADTGLDDDIENEADISMYGKEELLQVVEAMKTLLLKERQEKLQLEMHLRDEICNEMVEQMQQREQWCSEHLDTQKELLEEMYEEKLNILKESLTSFYQEEIQERDEKIEELEALLQEARQQSVAHQQSGSELALRRSQRLAASASTQQLQEVKAKLQQCKAELNSTTEELHKYQKMLEPPPSAKPFTIDVDKKLEEGQKNIRLLRTELQKLGESLQSAERACCHSTGAGKLRQALTTCDDILIKQDQTLAELQNNMVLVKLDLRKKAACIAEQYHTVLKLQGQVSAKKRLGTNQENQQPNQQPPGKKPFLRNLLPRTPTCQSSTDCSPYARILRSRRSPLLKSGPFGKKY

SEQ ID NO: 7177 - protein, 244 aa, Homo sapiens
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGAETVTPVLDPARRQGYGPLWYTSVGFGGLVQLRRGERVYVNISHPDMVDFARGKTFFGAVMVG

SEQ ID NO: 7178 - protein, 77 aa, Homo sapiens
MGALGLEGRGGRLQGRGSLLLAVAGATSLVTLLLAVPITVLAVLALVPQDQGGLGFRSCQRRSQKQISAPGSQLPTS

SEQ ID NO: 7179 - DNA, 1929 bp, Homo sapiens
gcagacacccagccactctgagcagaactgacagcatgaaggtacggggcccagggtcgggggactcatagcatgggggaactgagcccactccagaggcccctggccacagagggcactatgaaggcacaaggagttctcttgaaactcgcactcctggccctgccgctgctgctgcttctctccacgcccccgtgtgccccccaggtctccgggatccgaggagatgctctggagaggttttgccttcagcaacccctggactgtgacgacatctatgcccagggctaccagtcagacggcgtgtacctcatctacccctcgggccccagtgtgcctgtgcccgtcttctgtgacatgaccaccgagggcgggaagtggacggttttccagaagagattcaatggctcagtaagtttcttccgcggctggaatgactacaagctgggcttcggccgtgctgatggagagtactggctggggctgcagaacatgcacctcctgacactgaagcagaagtatgagctgcgagtggacttggaggactttgagaacaacacggcctatgccaagtacgctgacttctccatctccccgaacgcggtcagcgcagaggaggatggctacaccctctttgtggcaggctttgaggatggcggggcaggtgactccctgtcctaccacagtggccagaagttctctaccttcgaccgggaccaggacctctttgtgcagaactgcgcagctctctcctcaggagccttctggttccgcagctgccactttgccaacctcaatggcttctacctaggtggctcccacctctcttatgccaatggcatcaactgggcccagtggaagggcttctactactccctcaaacgcactgagatgaaaatccgccgggcctgaagggctggccccctcaggcacctttcctcccctggacacccatggtctccatgagtgctccctctgctgcccctgatgcatgcttctgctgattcccgagcaccaactccttacaagggggccttgtggctctcagccatgccacatccctgtcacacacccagggcatccattcctaagccagacccggctcccctacacctgaagttacactgccagcagttccccaggcctcttccgagaggcacatggttctagcctggacctggctgggctccatgagaatgagttgcctccaacctgtcccaacagctgacagccaggagccactctcccagctgcaggcctttgtggtccatcttgtcctgcttcctcactgtggacccctgtctgggccaccctagtgtgctaagctgagcagtgcagtgtgaacagggcccatggtgtattctaggccacagcccagcactcctctgggctgctctcaaaccatgtcccatcttcagcatccctcccaccaacttactcccctgtggtgagtaccgtggaaccccagcccacctcactatcatactcagcttcccctgatggcccatcccagcccctgaagctctatgccaagaacacagctaccgcacaccaccctgaaacagccacagccaaggtaggcatgcatatgaggtcttccccataccctctgggtgttgagaggtttagccacatgagggagcagaggacaatctctgcagggctgggagtgggtagggactgaaggtctcaataaaccttcagaacctgaatgaactggcttcatacacacaaacatatttgtttatcccccaaatgtaggcacctggctcctccttgctcccctgctgatggtgtcctaccccgaactccaaaaattacacctggagtcaggtgcagaagggaaccttgtatttcacaggcctcattttgatggcaaaaagacagtgtaataataacataataataataaaaatataatactgaaaa

SEQ ID NO: 7180 - DNA, 1820 bp, Homo sapiens
gcagacacccagccactctgagcagaactgacagcatgaaggcactcctggccctgccgctgctgctgcttctctccacgcccccgtgtgccccccaggtctccgggatccgaggagatgctctggagaggttttgccttcagcaacccctggactgtgacgacatctatgcccagggctaccagtcagacggcgtgtacctcatctacccctcgggccccagtgtgcctgtgcccgtcttctgtgacatgaccaccgagggcgggaagtggacggttttccagaagagattcaatggctcagtaagtttcttccgcggctggaatgactacaagctgggcttcggccgtgctgatggagagtactggctggggctgcagaacatgcacctcctgacactgaagcagaagtatgagctgcgagtggacttggaggactttgagaacaacacggcctatgccaagtacgctgacttctccatctccccgaacgcggtcagcgcagaggaggatggctacaccctctttgtggcaggctttgaggatggcggggcaggtgactccctgtcctaccacagtggccagaagttctctaccttcgaccgggaccaggacctctttgtgcagaactgcgcagctctctcctcaggagccttctggttccgcagctgccactttgccaacctcaatggcttctacctaggtggctcccacctctcttatgccaatggcatcaactgggcccagtggaagggcttctactactccctcaaacgcactgagatgaaaatccgccgggcctgaagggctggccccctcaggcacctttcctcccctggacacccatggtctccatgagtgctccctctgctgcccctgatgcatgcttctgctgattcccgagcaccaactccttacaagggggccttgtggctctcagccatgccacatccctgtcacacacccagggcatccattcctaagccagacccggctcccctacacctgaagttacactgccagcagttccccaggcctcttccgagaggcacatggttctagcctggacctggctgggctccatgagaatgagttgcctccaacctgtcccaacagctgacagccaggagccactctcccagctgcaggcctttgtggtccatcttgtcctgcttcctcactgtggacccctgtctgggccaccctagtgtgctaagctgagcagtgcagtgtgaacagggcccatggtgtattctaggccacagcccagcactcctctgggctgctctcaaaccatgtcccatcttcagcatccctcccaccaacttactcccctgtggtgagtaccgtggaaccccagcccacctcactatcatactcagcttcccctgatggcccatcccagcccctgaagctctatgccaagaacacagctaccgcacaccaccctgaaacagccacagccaaggtaggcatgcatatgaggtcttccccataccctctgggtgttgagaggtttagccacatgagggagcagaggacaatctctgcagggctgggagtgggtagggactgaaggtctcaataaaccttcagaacctgaatgaactggcttcatacacacaaacatatttgtttatcccccaaatgtaggcacctggctcctccttgctcccctgctgatggtgtcctaccccgaactccaaaaattacacctggagtcaggtgcagaagggaaccttgtatttcacaggcctcattttgatggcaaaaagacagtgtaataataacataataataataaaaatataatactgaaaa

SEQ ID NO: 7181 - DNA, 1250 bp, Homo sapiens
acattcccgggccagcttctgtactgccaggtccgggtcggcggctgcactgcggatgagaccggtgcgactcatgaaggtgttcgtcacccgcaggatacccgccgagggtagggtcgcgctcgcccgggcggcagactgtgaggtggagcagtgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgccggaggccatcgaggaagtgaagaatggtggctggacctcgtggaagcccctctggctgtgtggctatggactcacgcagagcactgtcggcatcatcgggctggggcgcataggccaggccattgctcggcgtctgaaaccattcggtgtccagagatttctgtacacagggcgccagcccaggcctgaggaagcagcagaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggggcgacgtcgtaaaccaggacgacctgtaccaggccttggccagtggtaagattgcagctgctggactggatgtgacgagcccagaaccactgcctacaaaccaccctctcctgaccctgaagaactgtgtgattctgccccacattggcagtgccacccacagaacccgcaacaccatgtccttgttggcagctaacaacttgctggctggcctgagaggggagccgatgcctagtgaactcaagctgtagccaaacagtagagatggagggccgggaagcaaaccgtgccctggtattgtcagacacacccaggcttgatttggatccacaggcagagccaagggaaggtgtgattctctgaggaaagagtgattctgatatatgtacttgtcacattggtgttggacacatttgcgccaaaagtatggtaattctattattaaataattctctgaga

SEQ ID NO: 7182 - DNA, 3185 bp, Homo sapiens
gggggctgaggggctgccatggcggcggcgggccggctcccgagctcctgggccctcttctcgccgctcctcgcagggcttgcactactgggagtcgggccggtcccagcgcgggcgctgcacaacgtcacggccgagctctttggggccgaggcctggggcacccttgcggctttcggggacctcaactccgacaagcagacggatctcttcgtgctgcgggaaagaaatgacttaatcgtctttttggcagaccagaatgcaccctattttaaacccaaagtaaaggtatctttcaagaatcacagtgcattgataacaagtgtagtccctggggattatgatggagattctcaaatggatgtccttctgacatatcttcccaaaaattatgccaagagtgaattaggagctgttatcttctggggacaaaatcaaacattagatcctaacaatatgaccatactcaataggacttttcaagatgagccactaattatggatttcaatggtgatctaattcctgatatttttggtatcacaaatgaatccaaccagccacagatactattaggagggaatttatcatggcatccagcattgaccactacaagtaaaatgcgaattccacattctcatgcatttattgatctgactgaagattttacagcagatttattcctgacgacattgaatgccaccactagtaccttccagtttgaaatatgggaaaatttggatggaaacttctctgtcagtactatattggaaaaacctcaaaatatgatggtggttggacagtcagcatttgcagactttgatggagatggacacatggatcatttactgccaggctgtgaagataaaaattgccaaaagagtaccatctacttagtgagatctgggatgaagcagtgggttccagtcctacaagatttcagcaataagggcacactctggggctttgtgccatttgtggatgaacagcaaccaactgaaataccaattccaattacccttcatattggagactacaatatggatggctatccagacgctctggtcatactaaagaacacatctggaagcaaccagcaggcctttttactggagaacgtcccttgtaataatgcaagctgtgaagaggcgcgtcgaatgtttaaagtctactgggagctgacagacctaaatcaaattaaggatgccatggttgccaccttctttgacatttacgaagatggaatcttggacattgtagtgctaagtaaaggatatacaaagaatgattttgccattcatacactaaaaaataactttgaagcagatgcttattttgttaaagttattgttcttagtggtctgtgttctaatgactgtcctcgtaagataacaccctttggagtgaatcaacctggaccttatatcatgtatacaactgtagatgcaaatgggtatctgaaaaatggatcagctggccaactcagccaatccgcacatttagctctccaactaccatacaacgtgcttggtttaggtcggagcgcaaattttcttgaccatctctacgttggtattccccgtccatctggagaaaaatctatacgaaaacaagagtggactgcaatcattccaaattcccagctaattgtcattccataccctcacaatgtccctcgaagttggagtgccaaactgtatcttacaccaagtaatattgttctgcttactgctatagctctcatcggtgtctgtgttttcatcttggcaataattggcattttacattggcaggaaaagaaagcagatgatagagaaaaacgacaagaagcccaccggtttcattttgatgctatgtgacttgcctttaatattacataatggaatggctgttcacttgattagttgaaacacaaattctggcttgaaaaaataggggagattaaatattatttataaatgatgtatcccatggtaattattggaaagtattcaaataaatatggtttgaatatgtcacaaggtctttttttttaaagcactttgtatataaaaatttgggttctctattctgtagtgctgtacatttttgttcctttgtggaatgtgttgcatgtactccagtgtttgtgtatttataatcttatttgcatcatgatgatggaaaaagttgtgtaaataaaaataattaaatgagcaggaatttttgtgtccacttgacttggtcttgcttcttattctaatgatgcaaattatacttttgtgaatatatcacggagtcattaggcattcagcttcatcacagcaggtcaggggtctcactgatggcatacaatatagtgatcgggtactctgacttggtagcacagtaagacagacttgccttaaactcctaattcaaccacttacaaagtcattgtttgaacttggctcttgtttaacctctgtaaacctcagttttcttgtttattcagtggggctaatacttgagttactgtaaacattaaatgggatgatgtatgtgaagtgcttagcttggtgcctagcacagagtaagtggtcaatatgtggtagttgtcattattaatattttagatgatcttattagacttatacatctaattatagaaatacatagacttgatagaattttattttcaggcatgaagaaatattctttggaaaagctaaatttttggtgattgacataaagatttacttgctcatattaactaaaaattatagtactctccaagaattaatgtgccctaaaaattttcctccaaaaacttatccttatcatgtgataatgaagaacatttgatttcttgaaaggaaactgctgtaggcagcatctgggaatgcaaatcttcaatcacatttctattctcaaacacttggagaagtctataatttacattcagacttcaatgcaaattttgtattgtgaacttcacatttccaaaaagttactttaaaaagactttaagactgaaaaaaaaaagtttatcaatgctaataattttctagtatgcaaatggacatgtgatgcctataaaacacaaaaatttctctgaaaacaattttgttcttatttttttctttatagttcactgagattggcatgtgtttttactttgtatctaagcatgttaacatgtcttcttaataaatattccttattgaaa

SEQ ID NO: 7183 - DNA, 5855 bp, Homo sapiens
gcttcacaggctccagccgagcggacaggcgtggcggccggagccccagcatccctgcttgaggtccaggagcggagcccgcggccaccgccgcctgatcagcgcgaccccggcccgcgcccgccccgcccggcaagatgctgcccgtgtaccaggaggtgaagcccaacccgctgcaggacgcgaacctctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttatcatcttctctccaggggctctggaccatccgggcatacaaagcagaagagaggtgtcaggaactgtttgatgcacaccaggatttacattcagaggcttggttcttgtttttgacaacgtcccgctggtttgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaagatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtgaatccaaccaaaatgtcaagtccgttccgaaggcattttccactagtttttggactatgtaaaccacattgtacttttttttactttggcaacaaatatttatacatacaagatgctagttcatttgaatatttctcccaacttatccaaggatctccagctctaacaaaatggtttatttttatttaaatgtcaatagttgttttttaaaatccaaatcagaggtgcaggccaccagttaaatgccgtctatcaggttttgtgccttaagagactacagagtcaaagctcatttttaaaggagtaggacaaagttgtcacaggtttttgttgttgtttttattgcccccaaaattacatgttaatttccatttatatcagggattctatttacttgaagactgtgaagttgccattttgtctcattgttttctttgacataactaggatccattatttcccctgaaggcttcttgttagaaaatagtacagttacaaccaataggaacaacaaaaagaaaaagtttgtgacattgtagtagggagtgtgtaccccttactccccatcaaaaaaaaaaatggatacatggttaaaggatagaagggcaatattttatcatatgttctaaaagagaaggaagagaaaatactactttctcaaaatggaagcccttaaaggtgctttgatactgaaggacacaaatgtgaccgtccatcctcctttagagttgcatgacttggacacggtaactgttgcagttttagactcagcattgtgacacttcccaagaaggccaaacctctaaccgacattcctgaaatacgtggcattattcttttttggatttctcatttatggaaggctaaccctctgttgactgtaagccttttggtttgggctgtattgaaatcctttctaaattgcatgaataggctctgctaacgtgatgagacaaactgaaaattattgcaagcattgactataattatgcagtacgttctcaggatgcatccaggggttcattttcatgagcctgtccaggttagtttactcctgaccactaatagcattgtcatttgggctttctgttgaatgaatcaacaaaccacaatacttcctgggaccttttgtactttatttgaactatgagtctttaatttttcctgatgatggtggctgtaatatgttgagttcagtttactaaaggttttactattatggtttgaagtggagtctcatgacctctcagaataaggtgtcacctccctgaaattgcatatatgtatatagacatgcacacgtgtgcatttgtttgtatacatatatttgtccttcgtatagcaagttttttgctcatcagcagagagcaacagatgttttattgagtgaagccttaaaaagcacacaccacacacagctaactgccaaaatacattgaccgtagtagctgttcaactcctagtacttagaaatacacgtatggttaatgttcagtccaacaaaccacacacagtaaatgtttattaatagtcatggttcgtattttaggtgactgaaattgcatcagtgatcataatgaggtttgttaaaacgatagctatattcaaaatgtctatatgtttatttggacttttgaggttaaagacagtcatataaacgtcctgtttctgttttaatgttatcatagaattttttaatgaaactaaattcaattgaaataaatgatagttttcatctcca

SEQ ID NO: 7184 - DNA, 3081 bp, Homo sapiens
gcttcacaggctccagccgagcggacaggcgtggcggccggagccccagcatccctgcttgaggtccaggagcggagcccgcggccaccgccgcctgatcagcgcgaccccggcccgcgcccgccccgcccggcaagatgctgcccgtgtaccaggaggtgaagcccaacccgctgcaggacgcgaacctctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagagatgggatctcgctgtgttgtcctggctggtctcaaactcctaggctcaagcaatcctcctccctcctcaagcaaacctcagtgctgggattataggcatgagccactgtacctggctaaatgttgtttttttgatattcaatttttgtttatagaattttcatttgttttgctcttatacttttcatctttttatgtttattgaccaattaaatatcatttgggtaagcacctatttaagtgtcttaacaatttttctattgagtactctgggtttttgttttgtttttcttactgatttgtagaattctttatgtattctgaattgcagataccttccttctgtactaatgcttatctttttagccctgtaatattgtgttttcataaacatacttatcaatcttt

SEQ ID NO: 7185 - DNA, 5714 bp, Homo sapiens
gcttcacaggctccagccgagcggacaggcgtggcggccggagccccagcatccctgcttgaggtccaggagcggagcccgcggccaccgccgcctgatcagcgcgaccccggcccgcgcccgccccgcccggcaagatgctgcccgtgtaccaggaggtgaagcccaacccgctgcaggacgcgaacctctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatgttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttatcatcttctctccaggggctctggaccatccgggcatacaaagcagaagagaggtgtcaggaactgtttgatgcacaccaggatttacattcagaggcttggttcttgtttttgacaacgtcccgctggtttgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaagatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtgaatccaaccaaaatgtcaagtccgttccgaaggcattttccactagtttttggactatgtaaaccacattgtacttttttttactttggcaacaaatatttatacatacaagatgctagttcatttgaatatttctcccaacttatccaaggatctccagctctaacaaaatggtttatttttatttaaatgtcaatagttgttttttaaaatccaaatcagaggtgcaggccaccagttaaatgccgtctatcaggttttgtgccttaagagactacagagtcaaagctcatttttaaaggagtaggacaaagttgtcacaggtttttgttgttgtttttattgcccccaaaattacatgttaatttccatttatatcagggattctatttacttgaagactgtgaagttgccattttgtctcattgttttctttgacataactaggatccattatttcccctgaaggcttcttgttagaaaatagtacagttacaaccaataggaacaacaaaaagaaaaagtttgtgacattgtagtagggagtgtgtaccccttactccccatcaaaaaaaaaaatggatacatggttaaaggatagaagggcaatattttatcatatgttctaaaagagaaggaagagaaaatactactttctcaaaatggaagcccttaaaggtgctttgatactgaaggacacaaatgtgaccgtccatcctcctttagagttgcatgacttggacacggtaactgttgcagttttagactcagcattgtgacacttcccaagaaggccaaacctctaaccgacattcctgaaatacgtggcattattcttttttggatttctcatttatggaaggctaaccctctgttgactgtaagccttttggtttgggctgtattgaaatcctttctaaattgcatgaataggctctgctaacgtgatgagacaaactgaaaattattgcaagcattgactataattatgcagtacgttctcaggatgcatccaggggttcattttcatgagcctgtccaggttagtttactcctgaccactaatagcattgtcatttgggctttctgttgaatgaatcaacaaaccacaatacttcctgggaccttttgtactttatttgaactatgagtctttaatttttcctgatgatggtggctgtaatatgttgagttcagtttactaaaggttttactattatggtttgaagtggagtctcatgacctctcagaataaggtgtcacctccctgaaattgcatatatgtatatagacatgcacacgtgtgcatttgtttgtatacatatatttgtccttcgtatagcaagttttttgctcatcagcagagagcaacagatgttttattgagtgaagccttaaaaagcacacaccacacacagctaactgccaaaatacattgaccgtagtagctgttcaactcctagtacttagaaatacacgtatggttaatgttcagtccaacaaaccacacacagtaaatgtttattaatagtcatggttcgtattttaggtgactgaaattgcatcagtgatcataatgaggtttgttaaaacgatagctatattcaaaatgtctatatgtttatttggacttttgaggttaaagacagtcatataaacgtcctgtttctgttttaatgttatcatagaattttttaatgaaactaaattcaattgaaataaatgatagttttcatctcca

SEQ ID NO: 7186 - DNA, 2856 bp, Homo sapiens
gcttcacaggctccagccgagcggacaggcgtggcggccggagccccagcatccctgcttgaggtccaggagcggagcccgcggccaccgccgcctgatcagcgcgaccccggcccgcgcccgccccgcccggcaagatgctgcccgtgtaccaggaggtgaagcccaacccgctgcaggacgcgaacctctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagagatgggatctcgctgtgttgtcctggctggtctcaaactcctaggctcaagcaatcctcctccctcctcaagcaaacctcagtgctgggattataggcatgagccactgtacctggctaaatgttgtttttttgatattcaatttttgtttatagaattttcatttgttttgctcttatacttttcatctttttatgtttattgaccaattaaatatcatttgggtaagcacctatttaagtgtcttaacaatttttctattgagtactctgggtttttgttttgtttttcttactgatttgtagaattctttatgtattctgaattgcagataccttccttctgtactaatgcttatctttttagccctgtaatattgtgttttcataaacatacttatcaatcttt

SEQ ID NO: 7187 - DNA, 8881 bp, Homo sapiens
agagcatcctcagcagctgccaccgaagcagcctcctccttctctcttcctcctcctcctaccacggccgccgccaccaccgctgcggctgtgatctcctatcccctctggtcctccttcctcccccagttcctgctcctcctcccatcccctgctcctcctgcccagcagcgaagggcagaaccctcggctgccgccctccttcgctctgaccaagaagaggctggaacagaataacatacagaggacagctttctcttctgaggagtcagaagttcagttcgcccaacatggaatgacttgaggagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaaccaataagaagaaggagaaagagcgcccagagatctctcttccttcagactttgagcatacgattcatgtggggtttgatgcagtcaccggggaattcactggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggagataaaagtgcacatggatacatagcagcccatccttcgagtacaaaaacagcatctgagcctccattggcccctcctgtgtctgaagaagaagatgaagaggaagaagaagaagaagatgaaaatgagccaccaccagttatcgcaccaagaccagagcatacaaaatcaatctatactcgttctgtggttgaatccattgcttcaccagcagtaccaaataaagaggtcacaccaccctctgctgaaaatgccaattccagtactttgtacaggaacacagatcggcaaagaaaaaaatccaagatgacagatgaggagatcttagagaagctaagaagcattgtgagtgttggggacccaaagaaaaaatacacaagatttgaaaaaattggtcaaggggcatcaggtactgtttatacagcactagacattgcaacaggacaagaggtggccataaagcagatgaaccttcaacagcaacccaagaaggaattaattattaatgaaattctggtcatgagggaaaataagaaccctaatattgttaattatttagatagctacttggtgggtgatgaactatgggtagtcatggaatacttggctggtggctctctgactgatgtggtcacagagacctgtatggatgaaggacagatagcagctgtctgcagagagtgcctgcaagctttggatttcctgcactcaaaccaggtgatccatagagatataaagagtgacaatattcttctcgggatggatggctctgttaaattgactgactttgggttctgtgcccagatcactcctgagcaaagtaaacgaagcactatggtgggaaccccatattggatggcacctgaggtggtgactcgaaaagcttatggtccgaaagttgatatctggtctcttggaattatggcaattgaaatggtggaaggtgaacccccttaccttaatgaaaatccactcagggcattgtatctgatagccactaatggaactccagagctccagaatcctgagagactgtcagctgtattccgtgactttttaaatcgctgtcttgagatggatgtggataggcgaggatctgccaaggagcttttgcagcatccatttttaaaattagccaagcctctctccagcctgactcctctgattatcgctgcaaaggaagcaattaagaacagcagccgctaagactgcaagccttacacctcaccatctccctcatgagtaagactgaaataaaactctgctgcaggaaagatggaagaaaagacagtcaaatggggtgggggttctttacctttcaaatgaatagaaacttcttataagcctttttcctactccctcagattatgtaatttatttgtaagcctgaatcgcagcccaaacagggcagcaatgttgaagtgaccataaagtggtcacttccaccgtgaagcgaaagagccagtagtgaatcccctcattttgtgcattcactttgaagaaaaaggtttctcaaagatgcacactccctcttcatagtgttgtgtttgtttttaagttagagagtagtccctcttgcattcaaacctccttcaaaactccttacccaatgtgatgtttttcacttgcattgtcattagatgtccagaaaaaaaaaagatgtcaaaatgtttttctaaaaaaagaaagcaaaaaaagcaaggcaaaaaaaaaaaaaaaaacaaacaaaaacaaaaacaaaacaaaaacaagcaaacaaaaaataccagagcaagtactgtgtgaacatgtggaagtccatgccctaatagagttgcaattttttattcttcttctatagtggtggcttggtttgtgtacctatttttctgcatttgtattggaaaaggtttcttttaagacattttccaaaagtggagaggaatatgtgtgttcaggaagggctttcaaaaaactgtatatctaaataaagctcaaacggtgaaatcctgtcacattttcacaatgatgcttaaaagataattgagtaaaccaggttgttaatctccttaatacctgaaagaggacacactgaaactgaaactgtgacatcctgctaggtgagttcaggttctgaacctaggaaatcctcataggagaaaccacatttaaacaaagatgggactttctctgagagccaaaaccagataaatgtagaatactgaaatccttgttggacattaagtaaacaaagataatgatacctaaattaatcctctcttgtgcttatgaaacatatgcactgtaaaataggcataccaggaggaaatagatacattaatcatcatttacttatgatacaaattatttattttgacaatttataacgtttaaaaaagttttttaaagatctagagaaaggtgatatagtaaacattcaactctgtaagaaatgggaggtcagtgaaggctacatcccaatcaatatttggctctaagtacctcttcccatttttcctatgtatcacctatttctgtttcggaatatggtgtgttcatgcttagttctttgggcttttgaatatcaaaagcatattcataaatgtcttgaaattctctccagtggaaaataattttaacttacaatcatatcccaagaaatgtcagtccgacagaattccttatatgacttggggaaaataacaaaatttgactactatttcaccatatatctatttattaaaaaattcaacagttggcacttcctgaatcttctgagagtagaaaaatatctgcggagtgtctgtgtagaaaaggatatgcctctcttttgagtgtattgacaattttgtaaattacagaaagttgtttctctaagcctttgaaaaactaacaatttgtgttatagaaggcttcttaatttgcagtataaaagaatctaaacagaacttatgtacattcagccagaaggggaaagagatcagttacataggcctctctccttctttgccaaggtacatccatccatctaaccatccatatatccacatcttaaaatgaaagcactttctttagagtttcagcaaactatatagtgtacgtgtttatgttcaggagatgaccccactggtgtatttcctattttccctattgttttctttgactgtaaaagttgggagaggcttgacctcctccccttgaaaatgtccacagtgggataaaacaacaaatgtgaaaagaaaatgaaacggtaatattaatttgaagcatactatgttatactttgcaaaaacgaatctgggcctgtaatttttaatgccacactgctctaatgagagagagaggccttaattttgatttcatttaaaaataagtactttaaaaaatttttcactcatagtgccgggaaattcaatgaaatcctgggatgcaaataaaaatcagtacattagtgactgtgtcctgccagtggagagagcccaatacctggttaggaagccctattcattagttagcatcccttacatgttgagaaggccttttttttgttgttattttggagaccttggagcagtgacccttcagatcactgtaggcagagaaatggcttctctcttatgctttcagttcagcatattaacaatgaggagccaggtacttctttactaccactttgtaccaagatttgataataatatatcccaggaggcattacttttataaatttgtattcatgtaaattttcaaatgagaacagcttctaaagccccttccctgtattggagagttatgtatatttctaataagtattagaaagaagctgtttctcatgccacagtgatgctgaaggattcacatttggtacaatcgagtaacttgaacgccagattgttaacagtttattctctttccctggatttttaagctcatcttgacacaggtgagtctatccaaatctttgatgttgctagtgtgccctgagataacgagggcacatctttcaatgttgattccaaaatgtcctgagttaggaatagggcagtgggaaagtcagggaagggtgagaagcacagtagagattatttatttaaaaaaggaaagaacgttaatgttgttagcaaggatccagtgcgttgtcataatcccatgaggattttcagatgacacaatcccctcaaatcagtcaccatgttgggtaatgacttcgttcttgctgatctcgtgtgtgtgtcattgtaaatatttgtgtgtccatgttccattttggctactggatggccaagccatgtaagaagatttaactcaagtatttattctttatgttattcagatttctttcaggcttgtgaactgcaccccaatgtttgagtttaaccacctgatccttacatctatccctccccggtgaagcacattccattgctaaaagaaaaagaaacacgaaattgcttcctgttgtctgtataactgttttgatagtttgagatatttgtctataaatgatatttctcagctcaaagatcgtgtaaataattatattcctttgctcaatgggtttatttctaatgaggctgccagttctgagagattctataatatcacttttaaataacataaacagggattacaactatgtaaaaagaaatgcatatggacaaagactgggaacacagataattgaaatcagttgtgttagggtggtggaattatgtgaatttttttttctttttaaaattttatttgatattgttataatattgctttacaataaataaacagcagaaagggaactatagacacatagaaaagatgccagaagcagatgccttctggccagagcgcagagcatgcagggcagagatatttgctagttacaattattccataggctttatgcttgcctgggtgctgaggttggcacacgctcgggtatggcacacgctttcttaggagactattatctataagttaaagctagggagatgtcactattagaactccaaacacactcttctgctttaaaacaggttgtctgccctctgctttggtatggcattcgggtgtctgttttgtggttgctttagattggaggggtgaccattttattagcccccttgataacatctgttgcagatattgcctttctggaacgttttaacagactctcaggttgaattttggaggactagaaggataaaatccccagctcccaccattttcttgtccaacaggatattactgtatatcattcaggtaggattcttcttttaataaccaatagggcaagtcccactaatttcaatagaagttatgacttgcaattaaaagctgactttgaaatcattaaacaaatatgtaggactgtctctgcctgttggcattcagttatagttctgttaattttggcttgggatggtctccatgtgcttttttctgcctatttataggttgtttgcagtagttgtgatttttaaagagcaagggagaccatctaaccaaaggataacttccttctaactcaccaaagaaattttaggtgagaactttaataatgaggtagtcacctcagatatgctgcttagtttcactaaaagcagaccctatacctagagaagtcactggctttttattggtcattctcaatacagaaatacttaggggagtcttaaccctgccatccccggttgaatctcttggtctttatctaagctacttgcagttaatattcagttaagcaaaggtatggccagtagtgcaagtatctcccagtctctgagctctgaacaagaggactgaaattcagcatttgtaaactgacagtttgatgggcctgggatttgaagtgaactcagcacacaattctgaacgtgtatttgcatgtggactgggaaggaaataaatgggaacttggaaataatggaatatttctcctatgaaagaatttttcgtagaagatttgtttttgatataatctttctgttggttagcttttagtgttttcattccttttctgatccacactcctttaagtgaccaaatgaatataacccaacatgcattgggaatgtgtttaatattaaacaatgtctaactgaatctgcaaatgcgggaactgagatatcacctccatgtgcacacctgtgtgtacgagtattctatacaacttgtagcatttactgccacttaattgggttgaacttgcaagataaacttttggaaactgcttagtgccatcggagtctcctttagaagctgccatcaggcaaatgctatcccataataccagcagtaagcctggcaacatgttcaacagatttagtacccaagaggaaatcaacagcgatagtagagaatgagtcagatgtagtgggataaatactagcctaggaagaaggagccccggagtctaatatgagctttattactaaattgctatgtgacgctaggcaagtcacttaacctctccatggctgtttcctcatctgtaaaataagtgtattggactagatgatccttagggtctttccaaaagtctaacattctatggcattataggttgccttgcaaattcagcctgctatagtgatggcaaatatcacgtttaagcctgagtctcttatgttgcagttaaataaaagaactatgtaagatgatttttaaaattcaagcaaatgggccgggtgcggtggctcatacctgtaatcccagcactttgggaggccaaggcaggcggatcacctgaggtcaggagttcgagaccagcctgaccaacatagagaaaccccatctctactaaaaatacaaaattagccgggtgtggtggcgggcgcctgtaatcccagctacttgggaggctgaggtgggagaatcgcttgaacccaggaggcggaggttgtggtgagctgagatcatgccattgcactccagcctcggcaacaagagtgaaacttcgtctccaaaaaaaaaaactcaagcaaatgaagttcataataataggggatgttgataaaacttgtggcagccttccaattcatttacagttgtttcgttttgtttttgttttaatgtccattttctgttgactgttcccagttttcattttccatacagtctgtatgtaaagtctggttttcattaagctgtggccagtatttgccactacaacagaaacacactgtcacacttgctagaatataactgtacttgagcttctcctttcctgtgaagtagtgctgggctttctagagtttaattctcaagtggcacaagatagcagagcccatgcattttaatggctgagactgctaagagtgaacctaaacacttacaagttgcagagagaaatgaaaaagtaattacatgctattagcattgagaaatgttgacaaattaatttgttgggaaccaaagatagcatttctgatgacaactcccacagtgattggccagttgtatgatgagtacactgctggaaagagggtaaactgggagttagtggatggtcccaatgccctgcctacagcagagtgccaaccagccctgagtgcaaaattcaagttcaatgtgtgtgcttgtgtgtggtgtgctttatggacccgcaaataccatattcattattgatgataagatcttcacagaatcctgtagctactaatgcattgagtttttaatctcagtacatcagccaggaggagccagatcacagggtagtgatgtctactgggattatactcataacatctacacaaaacaagttgagaaggatccacgttttcattgtttatcagaattgtatctcatttggctgagcattacttttgtcagaatgtgttatctgtaaaccatgtgtagtgaaattcttctgtaactttggattaaaggtatttatggtctttttgtttgtttgatttttaagtaagttatttcttttgtagacctgctgatggtatggttccatccttctgacctcagcatccaatctttttaaggatttttgttttcaatattgttattttaaattgtggttgaagcaatagaaaattgaaatatggattgtgcatgactgtgtcttgagtgtaaaaatattgcagtttgaaacttggacctaaagtattgcaaataaaaatgacaaacatcaatga

SEQ ID NO: 7188 - DNA, 9126 bp, Homo sapiens
accgcgggcgggcagctgtgccagctaaccgtctgggatctcgcactgggggctgcagcttttccccgcctcgagccagtgtgcgggggcgggagaagagccagggggagcgggctgggcccggggctgcggctgcggccgcggggctgcggctccccagccccgccagctggagcgctcggaggtagaggaaaggtcttgacggggtggctggatccgtggcagaatccagttccagattctagacttgagggttctgggctgttggtctgtagaagcgaaggagagaaggactcaaatccaggccaagtgtatggctgtctgaggtattggaacagaaggaggtccattcctgttggtgacaacaccgtggccctgttctgggatgagcaaggtgtaaaggtttcccccaagaaagagcagctgagtccttgcatcttgtggcagctggtgtgcccagcactgagtctgtaggagctgaagccagcccggacccttctcatgggcagtgcccacctgtgctgaagtcctgcagcggtggcggtgtgaggagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaaccaataagaagaaggagaaagagcgcccagagatctctcttccttcagactttgagcatacgattcatgtggggtttgatgcagtcaccggggaattcactggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggagataaaagtgcacatggatacatagcagcccatccttcgagtacaaaaacagcatctgagcctccattggcccctcctgtgtctgaagaagaagatgaagaggaagaagaagaagaagatgaaaatgagccaccaccagttatcgcaccaagaccagagcatacaaaatcaatctatactcgttctgtggttgaatccattgcttcaccagcagtaccaaataaagaggtcacaccaccctctgctgaaaatgccaattccagtactttgtacaggaacacagatcggcaaagaaaaaaatccaagatgacagatgaggagatcttagagaagctaagaagcattgtgagtgttggggacccaaagaaaaaatacacaagatttgaaaaaattggtcaaggggcatcaggtactgtttatacagcactagacattgcaacaggacaagaggtggccataaagcagatgaaccttcaacagcaacccaagaaggaattaattattaatgaaattctggtcatgagggaaaataagaaccctaatattgttaattatttagatagctacttggtgggtgatgaactatgggtagtcatggaatacttggctggtggctctctgactgatgtggtcacagagacctgtatggatgaaggacagatagcagctgtctgcagagagtgcctgcaagctttggatttcctgcactcaaaccaggtgatccatagagatataaagagtgacaatattcttctcgggatggatggctctgttaaattgactgactttgggttctgtgcccagatcactcctgagcaaagtaaacgaagcactatggtgggaaccccatattggatggcacctgaggtggtgactcgaaaagcttatggtccgaaagttgatatctggtctcttggaattatggcaattgaaatggtggaaggtgaacccccttaccttaatgaaaatccactcagggcattgtatctgatagccactaatggaactccagagctccagaatcctgagagactgtcagctgtattccgtgactttttaaatcgctgtcttgagatggatgtggataggcgaggatctgccaaggagcttttgcagcatccatttttaaaattagccaagcctctctccagcctgactcctctgattatcgctgcaaaggaagcaattaagaacagcagccgctaagactgcaagccttacacctcaccatctccctcatgagtaagactgaaataaaactctgctgcaggaaagatggaagaaaagacagtcaaatggggtgggggttctttacctttcaaatgaatagaaacttcttataagcctttttcctactccctcagattatgtaatttatttgtaagcctgaatcgcagcccaaacagggcagcaatgttgaagtgaccataaagtggtcacttccaccgtgaagcgaaagagccagtagtgaatcccctcattttgtgcattcactttgaagaaaaaggtttctcaaagatgcacactccctcttcatagtgttgtgtttgtttttaagttagagagtagtccctcttgcattcaaacctccttcaaaactccttacccaatgtgatgtttttcacttgcattgtcattagatgtccagaaaaaaaaaagatgtcaaaatgtttttctaaaaaaagaaagcaaaaaaagcaaggcaaaaaaaaaaaaaaaaacaaacaaaaacaaaaacaaaacaaaaacaagcaaacaaaaaataccagagcaagtactgtgtgaacatgtggaagtccatgccctaatagagttgcaattttttattcttcttctatagtggtggcttggtttgtgtacctatttttctgcatttgtattggaaaaggtttcttttaagacattttccaaaagtggagaggaatatgtgtgttcaggaagggctttcaaaaaactgtatatctaaataaagctcaaacggtgaaatcctgtcacattttcacaatgatgcttaaaagataattgagtaaaccaggttgttaatctccttaatacctgaaagaggacacactgaaactgaaactgtgacatcctgctaggtgagttcaggttctgaacctaggaaatcctcataggagaaaccacatttaaacaaagatgggactttctctgagagccaaaaccagataaatgtagaatactgaaatccttgttggacattaagtaaacaaagataatgatacctaaattaatcctctcttgtgcttatgaaacatatgcactgtaaaataggcataccaggaggaaatagatacattaatcatcatttacttatgatacaaattatttattttgacaatttataacgtttaaaaaagttttttaaagatctagagaaaggtgatatagtaaacattcaactctgtaagaaatgggaggtcagtgaaggctacatcccaatcaatatttggctctaagtacctcttcccatttttcctatgtatcacctatttctgtttcggaatatggtgtgttcatgcttagttctttgggcttttgaatatcaaaagcatattcataaatgtcttgaaattctctccagtggaaaataattttaacttacaatcatatcccaagaaatgtcagtccgacagaattccttatatgacttggggaaaataacaaaatttgactactatttcaccatatatctatttattaaaaaattcaacagttggcacttcctgaatcttctgagagtagaaaaatatctgcggagtgtctgtgtagaaaaggatatgcctctcttttgagtgtattgacaattttgtaaattacagaaagttgtttctctaagcctttgaaaaactaacaatttgtgttatagaaggcttcttaatttgcagtataaaagaatctaaacagaacttatgtacattcagccagaaggggaaagagatcagttacataggcctctctccttctttgccaaggtacatccatccatctaaccatccatatatccacatcttaaaatgaaagcactttctttagagtttcagcaaactatatagtgtacgtgtttatgttcaggagatgaccccactggtgtatttcctattttccctattgttttctttgactgtaaaagttgggagaggcttgacctcctccccttgaaaatgtccacagtgggataaaacaacaaatgtgaaaagaaaatgaaacggtaatattaatttgaagcatactatgttatactttgcaaaaacgaatctgggcctgtaatttttaatgccacactgctctaatgagagagagaggccttaattttgatttcatttaaaaataagtactttaaaaaatttttcactcatagtgccgggaaattcaatgaaatcctgggatgcaaataaaaatcagtacattagtgactgtgtcctgccagtggagagagcccaatacctggttaggaagccctattcattagttagcatcccttacatgttgagaaggccttttttttgttgttattttggagaccttggagcagtgacccttcagatcactgtaggcagagaaatggcttctctcttatgctttcagttcagcatattaacaatgaggagccaggtacttctttactaccactttgtaccaagatttgataataatatatcccaggaggcattacttttataaatttgtattcatgtaaattttcaaatgagaacagcttctaaagccccttccctgtattggagagttatgtatatttctaataagtattagaaagaagctgtttctcatgccacagtgatgctgaaggattcacatttggtacaatcgagtaacttgaacgccagattgttaacagtttattctctttccctggatttttaagctcatcttgacacaggtgagtctatccaaatctttgatgttgctagtgtgccctgagataacgagggcacatctttcaatgttgattccaaaatgtcctgagttaggaatagggcagtgggaaagtcagggaagggtgagaagcacagtagagattatttatttaaaaaaggaaagaacgttaatgttgttagcaaggatccagtgcgttgtcataatcccatgaggattttcagatgacacaatcccctcaaatcagtcaccatgttgggtaatgacttcgttcttgctgatctcgtgtgtgtgtcattgtaaatatttgtgtgtccatgttccattttggctactggatggccaagccatgtaagaagatttaactcaagtatttattctttatgttattcagatttctttcaggcttgtgaactgcaccccaatgtttgagtttaaccacctgatccttacatctatccctccccggtgaagcacattccattgctaaaagaaaaagaaacacgaaattgcttcctgttgtctgtataactgttttgatagtttgagatatttgtctataaatgatatttctcagctcaaagatcgtgtaaataattatattcctttgctcaatgggtttatttctaatgaggctgccagttctgagagattctataatatcacttttaaataacataaacagggattacaactatgtaaaaagaaatgcatatggacaaagactgggaacacagataattgaaatcagttgtgttagggtggtggaattatgtgaatttttttttctttttaaaattttatttgatattgttataatattgctttacaataaataaacagcagaaagggaactatagacacatagaaaagatgccagaagcagatgccttctggccagagcgcagagcatgcagggcagagatatttgctagttacaattattccataggctttatgcttgcctgggtgctgaggttggcacacgctcgggtatggcacacgctttcttaggagactattatctataagttaaagctagggagatgtcactattagaactccaaacacactcttctgctttaaaacaggttgtctgccctctgctttggtatggcattcgggtgtctgttttgtggttgctttagattggaggggtgaccattttattagcccccttgataacatctgttgcagatattgcctttctggaacgttttaacagactctcaggttgaattttggaggactagaaggataaaatccccagctcccaccattttcttgtccaacaggatattactgtatatcattcaggtaggattcttcttttaataaccaatagggcaagtcccactaatttcaatagaagttatgacttgcaattaaaagctgactttgaaatcattaaacaaatatgtaggactgtctctgcctgttggcattcagttatagttctgttaattttggcttgggatggtctccatgtgcttttttctgcctatttataggttgtttgcagtagttgtgatttttaaagagcaagggagaccatctaaccaaaggataacttccttctaactcaccaaagaaattttaggtgagaactttaataatgaggtagtcacctcagatatgctgcttagtttcactaaaagcagaccctatacctagagaagtcactggctttttattggtcattctcaatacagaaatacttaggggagtcttaaccctgccatccccggttgaatctcttggtctttatctaagctacttgcagttaatattcagttaagcaaaggtatggccagtagtgcaagtatctcccagtctctgagctctgaacaagaggactgaaattcagcatttgtaaactgacagtttgatgggcctgggatttgaagtgaactcagcacacaattctgaacgtgtatttgcatgtggactgggaaggaaataaatgggaacttggaaataatggaatatttctcctatgaaagaatttttcgtagaagatttgtttttgatataatctttctgttggttagcttttagtgttttcattccttttctgatccacactcctttaagtgaccaaatgaatataacccaacatgcattgggaatgtgtttaatattaaacaatgtctaactgaatctgcaaatgcgggaactgagatatcacctccatgtgcacacctgtgtgtacgagtattctatacaacttgtagcatttactgccacttaattgggttgaacttgcaagataaacttttggaaactgcttagtgccatcggagtctcctttagaagctgccatcaggcaaatgctatcccataataccagcagtaagcctggcaacatgttcaacagatttagtacccaagaggaaatcaacagcgatagtagagaatgagtcagatgtagtgggataaatactagcctaggaagaaggagccccggagtctaatatgagctttattactaaattgctatgtgacgctaggcaagtcacttaacctctccatggctgtttcctcatctgtaaaataagtgtattggactagatgatccttagggtctttccaaaagtctaacattctatggcattataggttgccttgcaaattcagcctgctatagtgatggcaaatatcacgtttaagcctgagtctcttatgttgcagttaaataaaagaactatgtaagatgatttttaaaattcaagcaaatgggccgggtgcggtggctcatacctgtaatcccagcactttgggaggccaaggcaggcggatcacctgaggtcaggagttcgagaccagcctgaccaacatagagaaaccccatctctactaaaaatacaaaattagccgggtgtggtggcgggcgcctgtaatcccagctacttgggaggctgaggtgggagaatcgcttgaacccaggaggcggaggttgtggtgagctgagatcatgccattgcactccagcctcggcaacaagagtgaaacttcgtctccaaaaaaaaaaactcaagcaaatgaagttcataataataggggatgttgataaaacttgtggcagccttccaattcatttacagttgtttcgttttgtttttgttttaatgtccattttctgttgactgttcccagttttcattttccatacagtctgtatgtaaagtctggttttcattaagctgtggccagtatttgccactacaacagaaacacactgtcacacttgctagaatataactgtacttgagcttctcctttcctgtgaagtagtgctgggctttctagagtttaattctcaagtggcacaagatagcagagcccatgcattttaatggctgagactgctaagagtgaacctaaacacttacaagttgcagagagaaatgaaaaagtaattacatgctattagcattgagaaatgttgacaaattaatttgttgggaaccaaagatagcatttctgatgacaactcccacagtgattggccagttgtatgatgagtacactgctggaaagagggtaaactgggagttagtggatggtcccaatgccctgcctacagcagagtgccaaccagccctgagtgcaaaattcaagttcaatgtgtgtgcttgtgtgtggtgtgctttatggacccgcaaataccatattcattattgatgataagatcttcacagaatcctgtagctactaatgcattgagtttttaatctcagtacatcagccaggaggagccagatcacagggtagtgatgtctactgggattatactcataacatctacacaaaacaagttgagaaggatccacgttttcattgtttatcagaattgtatctcatttggctgagcattacttttgtcagaatgtgttatctgtaaaccatgtgtagtgaaattcttctgtaactttggattaaaggtatttatggtctttttgtttgtttgatttttaagtaagttatttcttttgtagacctgctgatggtatggttccatccttctgacctcagcatccaatctttttaaggatttttgttttcaatattgttattttaaattgtggttgaagcaatagaaaattgaaatatggattgtgcatgactgtgtcttgagtgtaaaaatattgcagtttgaaacttggacctaaagtattgcaaataaaaatgacaaacatcaatga

SEQ ID NO: 7189 - DNA, 8808 bp, Homo sapiens
agagcatcctcagcagctgccaccgaagcagcctcctccttctctcttcctcctcctcctaccacggccgccgccaccaccgctgcggctgtgatctcctatcccctctggtcctccttcctcccccagttcctgctcctcctcccatcccctgctcctcctgcccagcagcgaagggcagaaccctcggctgccgccctccttcgctctgaccaagaagaggctggaacaggagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaaccaataagaagaaggagaaagagcgcccagagatctctcttccttcagactttgagcatacgattcatgtggggtttgatgcagtcaccggggaattcactggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggagataaaagtgcacatggatacatagcagcccatccttcgagtacaaaaacagcatctgagcctccattggcccctcctgtgtctgaagaagaagatgaagaggaagaagaagaagaagatgaaaatgagccaccaccagttatcgcaccaagaccagagcatacaaaatcaatctatactcgttctgtggttgaatccattgcttcaccagcagtaccaaataaagaggtcacaccaccctctgctgaaaatgccaattccagtactttgtacaggaacacagatcggcaaagaaaaaaatccaagatgacagatgaggagatcttagagaagctaagaagcattgtgagtgttggggacccaaagaaaaaatacacaagatttgaaaaaattggtcaaggggcatcaggtactgtttatacagcactagacattgcaacaggacaagaggtggccataaagcagatgaaccttcaacagcaacccaagaaggaattaattattaatgaaattctggtcatgagggaaaataagaaccctaatattgttaattatttagatagctacttggtgggtgatgaactatgggtagtcatggaatacttggctggtggctctctgactgatgtggtcacagagacctgtatggatgaaggacagatagcagctgtctgcagagagtgcctgcaagctttggatttcctgcactcaaaccaggtgatccatagagatataaagagtgacaatattcttctcgggatggatggctctgttaaattgactgactttgggttctgtgcccagatcactcctgagcaaagtaaacgaagcactatggtgggaaccccatattggatggcacctgaggtggtgactcgaaaagcttatggtccgaaagttgatatctggtctcttggaattatggcaattgaaatggtggaaggtgaacccccttaccttaatgaaaatccactcagggcattgtatctgatagccactaatggaactccagagctccagaatcctgagagactgtcagctgtattccgtgactttttaaatcgctgtcttgagatggatgtggataggcgaggatctgccaaggagcttttgcagcatccatttttaaaattagccaagcctctctccagcctgactcctctgattatcgctgcaaaggaagcaattaagaacagcagccgctaagactgcaagccttacacctcaccatctccctcatgagtaagactgaaataaaactctgctgcaggaaagatggaagaaaagacagtcaaatggggtgggggttctttacctttcaaatgaatagaaacttcttataagcctttttcctactccctcagattatgtaatttatttgtaagcctgaatcgcagcccaaacagggcagcaatgttgaagtgaccataaagtggtcacttccaccgtgaagcgaaagagccagtagtgaatcccctcattttgtgcattcactttgaagaaaaaggtttctcaaagatgcacactccctcttcatagtgttgtgtttgtttttaagttagagagtagtccctcttgcattcaaacctccttcaaaactccttacccaatgtgatgtttttcacttgcattgtcattagatgtccagaaaaaaaaaagatgtcaaaatgtttttctaaaaaaagaaagcaaaaaaagcaaggcaaaaaaaaaaaaaaaaacaaacaaaaacaaaaacaaaacaaaaacaagcaaacaaaaaataccagagcaagtactgtgtgaacatgtggaagtccatgccctaatagagttgcaattttttattcttcttctatagtggtggcttggtttgtgtacctatttttctgcatttgtattggaaaaggtttcttttaagacattttccaaaagtggagaggaatatgtgtgttcaggaagggctttcaaaaaactgtatatctaaataaagctcaaacggtgaaatcctgtcacattttcacaatgatgcttaaaagataattgagtaaaccaggttgttaatctccttaatacctgaaagaggacacactgaaactgaaactgtgacatcctgctaggtgagttcaggttctgaacctaggaaatcctcataggagaaaccacatttaaacaaagatgggactttctctgagagccaaaaccagataaatgtagaatactgaaatccttgttggacattaagtaaacaaagataatgatacctaaattaatcctctcttgtgcttatgaaacatatgcactgtaaaataggcataccaggaggaaatagatacattaatcatcatttacttatgatacaaattatttattttgacaatttataacgtttaaaaaagttttttaaagatctagagaaaggtgatatagtaaacattcaactctgtaagaaatgggaggtcagtgaaggctacatcccaatcaatatttggctctaagtacctcttcccatttttcctatgtatcacctatttctgtttcggaatatggtgtgttcatgcttagttctttgggcttttgaatatcaaaagcatattcataaatgtcttgaaattctctccagtggaaaataattttaacttacaatcatatcccaagaaatgtcagtccgacagaattccttatatgacttggggaaaataacaaaatttgactactatttcaccatatatctatttattaaaaaattcaacagttggcacttcctgaatcttctgagagtagaaaaatatctgcggagtgtctgtgtagaaaaggatatgcctctcttttgagtgtattgacaattttgtaaattacagaaagttgtttctctaagcctttgaaaaactaacaatttgtgttatagaaggcttcttaatttgcagtataaaagaatctaaacagaacttatgtacattcagccagaaggggaaagagatcagttacataggcctctctccttctttgccaaggtacatccatccatctaaccatccatatatccacatcttaaaatgaaagcactttctttagagtttcagcaaactatatagtgtacgtgtttatgttcaggagatgaccccactggtgtatttcctattttccctattgttttctttgactgtaaaagttgggagaggcttgacctcctccccttgaaaatgtccacagtgggataaaacaacaaatgtgaaaagaaaatgaaacggtaatattaatttgaagcatactatgttatactttgcaaaaacgaatctgggcctgtaatttttaatgccacactgctctaatgagagagagaggccttaattttgatttcatttaaaaataagtactttaaaaaatttttcactcatagtgccgggaaattcaatgaaatcctgggatgcaaataaaaatcagtacattagtgactgtgtcctgccagtggagagagcccaatacctggttaggaagccctattcattagttagcatcccttacatgttgagaaggccttttttttgttgttattttggagaccttggagcagtgacccttcagatcactgtaggcagagaaatggcttctctcttatgctttcagttcagcatattaacaatgaggagccaggtacttctttactaccactttgtaccaagatttgataataatatatcccaggaggcattacttttataaatttgtattcatgtaaattttcaaatgagaacagcttctaaagccccttccctgtattggagagttatgtatatttctaataagtattagaaagaagctgtttctcatgccacagtgatgctgaaggattcacatttggtacaatcgagtaacttgaacgccagattgttaacagtttattctctttccctggatttttaagctcatcttgacacaggtgagtctatccaaatctttgatgttgctagtgtgccctgagataacgagggcacatctttcaatgttgattccaaaatgtcctgagttaggaatagggcagtgggaaagtcagggaagggtgagaagcacagtagagattatttatttaaaaaaggaaagaacgttaatgttgttagcaaggatccagtgcgttgtcataatcccatgaggattttcagatgacacaatcccctcaaatcagtcaccatgttgggtaatgacttcgttcttgctgatctcgtgtgtgtgtcattgtaaatatttgtgtgtccatgttccattttggctactggatggccaagccatgtaagaagatttaactcaagtatttattctttatgttattcagatttctttcaggcttgtgaactgcaccccaatgtttgagtttaaccacctgatccttacatctatccctccccggtgaagcacattccattgctaaaagaaaaagaaacacgaaattgcttcctgttgtctgtataactgttttgatagtttgagatatttgtctataaatgatatttctcagctcaaagatcgtgtaaataattatattcctttgctcaatgggtttatttctaatgaggctgccagttctgagagattctataatatcacttttaaataacataaacagggattacaactatgtaaaaagaaatgcatatggacaaagactgggaacacagataattgaaatcagttgtgttagggtggtggaattatgtgaatttttttttctttttaaaattttatttgatattgttataatattgctttacaataaataaacagcagaaagggaactatagacacatagaaaagatgccagaagcagatgccttctggccagagcgcagagcatgcagggcagagatatttgctagttacaattattccataggctttatgcttgcctgggtgctgaggttggcacacgctcgggtatggcacacgctttcttaggagactattatctataagttaaagctagggagatgtcactattagaactccaaacacactcttctgctttaaaacaggttgtctgccctctgctttggtatggcattcgggtgtctgttttgtggttgctttagattggaggggtgaccattttattagcccccttgataacatctgttgcagatattgcctttctggaacgttttaacagactctcaggttgaattttggaggactagaaggataaaatccccagctcccaccattttcttgtccaacaggatattactgtatatcattcaggtaggattcttcttttaataaccaatagggcaagtcccactaatttcaatagaagttatgacttgcaattaaaagctgactttgaaatcattaaacaaatatgtaggactgtctctgcctgttggcattcagttatagttctgttaattttggcttgggatggtctccatgtgcttttttctgcctatttataggttgtttgcagtagttgtgatttttaaagagcaagggagaccatctaaccaaaggataacttccttctaactcaccaaagaaattttaggtgagaactttaataatgaggtagtcacctcagatatgctgcttagtttcactaaaagcagaccctatacctagagaagtcactggctttttattggtcattctcaatacagaaatacttaggggagtcttaaccctgccatccccggttgaatctcttggtctttatctaagctacttgcagttaatattcagttaagcaaaggtatggccagtagtgcaagtatctcccagtctctgagctctgaacaagaggactgaaattcagcatttgtaaactgacagtttgatgggcctgggatttgaagtgaactcagcacacaattctgaacgtgtatttgcatgtggactgggaaggaaataaatgggaacttggaaataatggaatatttctcctatgaaagaatttttcgtagaagatttgtttttgatataatctttctgttggttagcttttagtgttttcattccttttctgatccacactcctttaagtgaccaaatgaatataacccaacatgcattgggaatgtgtttaatattaaacaatgtctaactgaatctgcaaatgcgggaactgagatatcacctccatgtgcacacctgtgtgtacgagtattctatacaacttgtagcatttactgccacttaattgggttgaacttgcaagataaacttttggaaactgcttagtgccatcggagtctcctttagaagctgccatcaggcaaatgctatcccataataccagcagtaagcctggcaacatgttcaacagatttagtacccaagaggaaatcaacagcgatagtagagaatgagtcagatgtagtgggataaatactagcctaggaagaaggagccccggagtctaatatgagctttattactaaattgctatgtgacgctaggcaagtcacttaacctctccatggctgtttcctcatctgtaaaataagtgtattggactagatgatccttagggtctttccaaaagtctaacattctatggcattataggttgccttgcaaattcagcctgctatagtgatggcaaatatcacgtttaagcctgagtctcttatgttgcagttaaataaaagaactatgtaagatgatttttaaaattcaagcaaatgggccgggtgcggtggctcatacctgtaatcccagcactttgggaggccaaggcaggcggatcacctgaggtcaggagttcgagaccagcctgaccaacatagagaaaccccatctctactaaaaatacaaaattagccgggtgtggtggcgggcgcctgtaatcccagctacttgggaggctgaggtgggagaatcgcttgaacccaggaggcggaggttgtggtgagctgagatcatgccattgcactccagcctcggcaacaagagtgaaacttcgtctccaaaaaaaaaaactcaagcaaatgaagttcataataataggggatgttgataaaacttgtggcagccttccaattcatttacagttgtttcgttttgtttttgttttaatgtccattttctgttgactgttcccagttttcattttccatacagtctgtatgtaaagtctggttttcattaagctgtggccagtatttgccactacaacagaaacacactgtcacacttgctagaatataactgtacttgagcttctcctttcctgtgaagtagtgctgggctttctagagtttaattctcaagtggcacaagatagcagagcccatgcattttaatggctgagactgctaagagtgaacctaaacacttacaagttgcagagagaaatgaaaaagtaattacatgctattagcattgagaaatgttgacaaattaatttgttgggaaccaaagatagcatttctgatgacaactcccacagtgattggccagttgtatgatgagtacactgctggaaagagggtaaactgggagttagtggatggtcccaatgccctgcctacagcagagtgccaaccagccctgagtgcaaaattcaagttcaatgtgtgtgcttgtgtgtggtgtgctttatggacccgcaaataccatattcattattgatgataagatcttcacagaatcctgtagctactaatgcattgagtttttaatctcagtacatcagccaggaggagccagatcacagggtagtgatgtctactgggattatactcataacatctacacaaaacaagttgagaaggatccacgttttcattgtttatcagaattgtatctcatttggctgagcattacttttgtcagaatgtgttatctgtaaaccatgtgtagtgaaattcttctgtaactttggattaaaggtatttatggtctttttgtttgtttgatttttaagtaagttatttcttttgtagacctgctgatggtatggttccatccttctgacctcagcatccaatctttttaaggatttttgttttcaatattgttattttaaattgtggttgaagcaatagaaaattgaaatatggattgtgcatgactgtgtcttgagtgtaaaaatattgcagtttgaaacttggacctaaagtattgcaaataaaaatgacaaacatcaatga

SEQ ID NO: 7190 - DNA, 9237 bp, Homo sapiens
accgcgggcgggcagctgtgccagctaaccgtctgggatctcgcactgggggctgcagcttttccccgcctcgagccagtgtgcgggggcgggagaagagccagggggagcgggctgggcccggggctgcggctgcggccgcggggctgcggctccccagccccgccagctggagcgctcggaggtagaggaaaggtcttgacggggtggctggatccgtggcagaatccagttccagattctagacttgagggttctgggctgttggtctgtagaagcgaaggagagaaggactcaaatccaggccaagtgtatggctgtctgaggtattggaacagaaggaggtccattcctgttggtgacaacaccgtggccctgttctgggatgagcaaggtgtaaagcaggtttcccccaagaaagagcagctgagtccttgcatcttgtggcagctggtgtgcccagcactgagtctgtaggagctgaagccagcccggacccttctcatgggcagtgcccacctgtgctgaagtcctgcagcggtggcggtgtgaggagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaaccaataagaagaaggagaaagagcgcccagagatctctcttccttcagactttgagcatacgattcatgtggggtttgatgcagtcaccggggaattcactaactcccctttccagacctctagacctgtgacggtcgcttcaagtcaatcagagggaaaaatgccagatctctatggctcacagatgtgcccagggaagctcccagagggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggagataaaagtgcacatggatacatagcagcccatccttcgagtacaaaaacagcatctgagcctccattggcccctcctgtgtctgaagaagaagatgaagaggaagaagaagaagaagatgaaaatgagccaccaccagttatcgcaccaagaccagagcatacaaaatcaatctatactcgttctgtggttgaatccattgcttcaccagcagtaccaaataaagaggtcacaccaccctctgctgaaaatgccaattccagtactttgtacaggaacacagatcggcaaagaaaaaaatccaagatgacagatgaggagatcttagagaagctaagaagcattgtgagtgttggggacccaaagaaaaaatacacaagatttgaaaaaattggtcaaggggcatcaggtactgtttatacagcactagacattgcaacaggacaagaggtggccataaagcagatgaaccttcaacagcaacccaagaaggaattaattattaatgaaattctggtcatgagggaaaataagaaccctaatattgttaattatttagatagctacttggtgggtgatgaactatgggtagtcatggaatacttggctggtggctctctgactgatgtggtcacagagacctgtatggatgaaggacagatagcagctgtctgcagagagtgcctgcaagctttggatttcctgcactcaaaccaggtgatccatagagatataaagagtgacaatattcttctcgggatggatggctctgttaaattgactgactttgggttctgtgcccagatcactcctgagcaaagtaaacgaagcactatggtgggaaccccatattggatggcacctgaggtggtgactcgaaaagcttatggtccgaaagttgatatctggtctcttggaattatggcaattgaaatggtggaaggtgaacccccttaccttaatgaaaatccactcagggcattgtatctgatagccactaatggaactccagagctccagaatcctgagagactgtcagctgtattccgtgactttttaaatcgctgtcttgagatggatgtggataggcgaggatctgccaaggagcttttgcagcatccatttttaaaattagccaagcctctctccagcctgactcctctgattatcgctgcaaaggaagcaattaagaacagcagccgctaagactgcaagccttacacctcaccatctccctcatgagtaagactgaaataaaactctgctgcaggaaagatggaagaaaagacagtcaaatggggtgggggttctttacctttcaaatgaatagaaacttcttataagcctttttcctactccctcagattatgtaatttatttgtaagcctgaatcgcagcccaaacagggcagcaatgttgaagtgaccataaagtggtcacttccaccgtgaagcgaaagagccagtagtgaatcccctcattttgtgcattcactttgaagaaaaaggtttctcaaagatgcacactccctcttcatagtgttgtgtttgtttttaagttagagagtagtccctcttgcattcaaacctccttcaaaactccttacccaatgtgatgtttttcacttgcattgtcattagatgtccagaaaaaaaaaagatgtcaaaatgtttttctaaaaaaagaaagcaaaaaaagcaaggcaaaaaaaaaaaaaaaaacaaacaaaaacaaaaacaaaacaaaaacaagcaaacaaaaaataccagagcaagtactgtgtgaacatgtggaagtccatgccctaatagagttgcaattttttattcttcttctatagtggtggcttggtttgtgtacctatttttctgcatttgtattggaaaaggtttcttttaagacattttccaaaagtggagaggaatatgtgtgttcaggaagggctttcaaaaaactgtatatctaaataaagctcaaacggtgaaatcctgtcacattttcacaatgatgcttaaaagataattgagtaaaccaggttgttaatctccttaatacctgaaagaggacacactgaaactgaaactgtgacatcctgctaggtgagttcaggttctgaacctaggaaatcctcataggagaaaccacatttaaacaaagatgggactttctctgagagccaaaaccagataaatgtagaatactgaaatccttgttggacattaagtaaacaaagataatgatacctaaattaatcctctcttgtgcttatgaaacatatgcactgtaaaataggcataccaggaggaaatagatacattaatcatcatttacttatgatacaaattatttattttgacaatttataacgtttaaaaaagttttttaaagatctagagaaaggtgatatagtaaacattcaactctgtaagaaatgggaggtcagtgaaggctacatcccaatcaatatttggctctaagtacctcttcccatttttcctatgtatcacctatttctgtttcggaatatggtgtgttcatgcttagttctttgggcttttgaatatcaaaagcatattcataaatgtcttgaaattctctccagtggaaaataattttaacttacaatcatatcccaagaaatgtcagtccgacagaattccttatatgacttggggaaaataacaaaatttgactactatttcaccatatatctatttattaaaaaattcaacagttggcacttcctgaatcttctgagagtagaaaaatatctgcggagtgtctgtgtagaaaaggatatgcctctcttttgagtgtattgacaattttgtaaattacagaaagttgtttctctaagcctttgaaaaactaacaatttgtgttatagaaggcttcttaatttgcagtataaaagaatctaaacagaacttatgtacattcagccagaaggggaaagagatcagttacataggcctctctccttctttgccaaggtacatccatccatctaaccatccatatatccacatcttaaaatgaaagcactttctttagagtttcagcaaactatatagtgtacgtgtttatgttcaggagatgaccccactggtgtatttcctattttccctattgttttctttgactgtaaaagttgggagaggcttgacctcctccccttgaaaatgtccacagtgggataaaacaacaaatgtgaaaagaaaatgaaacggtaatattaatttgaagcatactatgttatactttgcaaaaacgaatctgggcctgtaatttttaatgccacactgctctaatgagagagagaggccttaattttgatttcatttaaaaataagtactttaaaaaatttttcactcatagtgccgggaaattcaatgaaatcctgggatgcaaataaaaatcagtacattagtgactgtgtcctgccagtggagagagcccaatacctggttaggaagccctattcattagttagcatcccttacatgttgagaaggccttttttttgttgttattttggagaccttggagcagtgacccttcagatcactgtaggcagagaaatggcttctctcttatgctttcagttcagcatattaacaatgaggagccaggtacttctttactaccactttgtaccaagatttgataataatatatcccaggaggcattacttttataaatttgtattcatgtaaattttcaaatgagaacagcttctaaagccccttccctgtattggagagttatgtatatttctaataagtattagaaagaagctgtttctcatgccacagtgatgctgaaggattcacatttggtacaatcgagtaacttgaacgccagattgttaacagtttattctctttccctggatttttaagctcatcttgacacaggtgagtctatccaaatctttgatgttgctagtgtgccctgagataacgagggcacatctttcaatgttgattccaaaatgtcctgagttaggaatagggcagtgggaaagtcagggaagggtgagaagcacagtagagattatttatttaaaaaaggaaagaacgttaatgttgttagcaaggatccagtgcgttgtcataatcccatgaggattttcagatgacacaatcccctcaaatcagtcaccatgttgggtaatgacttcgttcttgctgatctcgtgtgtgtgtcattgtaaatatttgtgtgtccatgttccattttggctactggatggccaagccatgtaagaagatttaactcaagtatttattctttatgttattcagatttctttcaggcttgtgaactgcaccccaatgtttgagtttaaccacctgatccttacatctatccctccccggtgaagcacattccattgctaaaagaaaaagaaacacgaaattgcttcctgttgtctgtataactgttttgatagtttgagatatttgtctataaatgatatttctcagctcaaagatcgtgtaaataattatattcctttgctcaatgggtttatttctaatgaggctgccagttctgagagattctataatatcacttttaaataacataaacagggattacaactatgtaaaaagaaatgcatatggacaaagactgggaacacagataattgaaatcagttgtgttagggtggtggaattatgtgaatttttttttctttttaaaattttatttgatattgttataatattgctttacaataaataaacagcagaaagggaactatagacacatagaaaagatgccagaagcagatgccttctggccagagcgcagagcatgcagggcagagatatttgctagttacaattattccataggctttatgcttgcctgggtgctgaggttggcacacgctcgggtatggcacacgctttcttaggagactattatctataagttaaagctagggagatgtcactattagaactccaaacacactcttctgctttaaaacaggttgtctgccctctgctttggtatggcattcgggtgtctgttttgtggttgctttagattggaggggtgaccattttattagcccccttgataacatctgttgcagatattgcctttctggaacgttttaacagactctcaggttgaattttggaggactagaaggataaaatccccagctcccaccattttcttgtccaacaggatattactgtatatcattcaggtaggattcttcttttaataaccaatagggcaagtcccactaatttcaatagaagttatgacttgcaattaaaagctgactttgaaatcattaaacaaatatgtaggactgtctctgcctgttggcattcagttatagttctgttaattttggcttgggatggtctccatgtgcttttttctgcctatttataggttgtttgcagtagttgtgatttttaaagagcaagggagaccatctaaccaaaggataacttccttctaactcaccaaagaaattttaggtgagaactttaataatgaggtagtcacctcagatatgctgcttagtttcactaaaagcagaccctatacctagagaagtcactggctttttattggtcattctcaatacagaaatacttaggggagtcttaaccctgccatccccggttgaatctcttggtctttatctaagctacttgcagttaatattcagttaagcaaaggtatggccagtagtgcaagtatctcccagtctctgagctctgaacaagaggactgaaattcagcatttgtaaactgacagtttgatgggcctgggatttgaagtgaactcagcacacaattctgaacgtgtatttgcatgtggactgggaaggaaataaatgggaacttggaaataatggaatatttctcctatgaaagaatttttcgtagaagatttgtttttgatataatctttctgttggttagcttttagtgttttcattccttttctgatccacactcctttaagtgaccaaatgaatataacccaacatgcattgggaatgtgtttaatattaaacaatgtctaactgaatctgcaaatgcgggaactgagatatcacctccatgtgcacacctgtgtgtacgagtattctatacaacttgtagcatttactgccacttaattgggttgaacttgcaagataaacttttggaaactgcttagtgccatcggagtctcctttagaagctgccatcaggcaaatgctatcccataataccagcagtaagcctggcaacatgttcaacagatttagtacccaagaggaaatcaacagcgatagtagagaatgagtcagatgtagtgggataaatactagcctaggaagaaggagccccggagtctaatatgagctttattactaaattgctatgtgacgctaggcaagtcacttaacctctccatggctgtttcctcatctgtaaaataagtgtattggactagatgatccttagggtctttccaaaagtctaacattctatggcattataggttgccttgcaaattcagcctgctatagtgatggcaaatatcacgtttaagcctgagtctcttatgttgcagttaaataaaagaactatgtaagatgatttttaaaattcaagcaaatgggccgggtgcggtggctcatacctgtaatcccagcactttgggaggccaaggcaggcggatcacctgaggtcaggagttcgagaccagcctgaccaacatagagaaaccccatctctactaaaaatacaaaattagccgggtgtggtggcgggcgcctgtaatcccagctacttgggaggctgaggtgggagaatcgcttgaacccaggaggcggaggttgtggtgagctgagatcatgccattgcactccagcctcggcaacaagagtgaaacttcgtctccaaaaaaaaaaactcaagcaaatgaagttcataataataggggatgttgataaaacttgtggcagccttccaattcatttacagttgtttcgttttgtttttgttttaatgtccattttctgttgactgttcccagttttcattttccatacagtctgtatgtaaagtctggttttcattaagctgtggccagtatttgccactacaacagaaacacactgtcacacttgctagaatataactgtacttgagcttctcctttcctgtgaagtagtgctgggctttctagagtttaattctcaagtggcacaagatagcagagcccatgcattttaatggctgagactgctaagagtgaacctaaacacttacaagttgcagagagaaatgaaaaagtaattacatgctattagcattgagaaatgttgacaaattaatttgttgggaaccaaagatagcatttctgatgacaactcccacagtgattggccagttgtatgatgagtacactgctggaaagagggtaaactgggagttagtggatggtcccaatgccctgcctacagcagagtgccaaccagccctgagtgcaaaattcaagttcaatgtgtgtgcttgtgtgtggtgtgctttatggacccgcaaataccatattcattattgatgataagatcttcacagaatcctgtagctactaatgcattgagtttttaatctcagtacatcagccaggaggagccagatcacagggtagtgatgtctactgggattatactcataacatctacacaaaacaagttgagaaggatccacgttttcattgtttatcagaattgtatctcatttggctgagcattacttttgtcagaatgtgttatctgtaaaccatgtgtagtgaaattcttctgtaactttggattaaaggtatttatggtctttttgtttgtttgatttttaagtaagttatttcttttgtagacctgctgatggtatggttccatccttctgacctcagcatccaatctttttaaggatttttgttttcaatattgttattttaaattgtggttgaagcaatagaaaattgaaatatggattgtgcatgactgtgtcttgagtgtaaaaatattgcagtttgaaacttggacctaaagtattgcaaataaaaatgacaaacatcaatga

SEQ ID NO: 7191 - DNA, 1961 bp, Homo sapiens
ggggtgggggctgtggccgtgtctagctgttcgggtgtgctgtggtcatcctccctgcgcacctacagccgcagaccgccggtggggggcgggggatgccgggctgccgcatcagcgcctgcggcccgggggcccaggaggggacggcagagcagaggtcgccgccgccgccctgggatcccatgccgtcctctcagcccccgcccccaactccgaccttgactcctaccccgaccccgggtcagtccccgccgctgccggacgcagctggggcttcagcaggcgcggccgaggaccaggagctgcagcgctggcgccagggcgctagcgggatcgcggggctcgccggccccggagggggctctggcgcggctgcgggggcggggggccgcgcgctggagctggccgaagcacggcggcggctgctggaggtggagggccgccggcgcctggtgtcggagctggagagccgcgtgctgcagctgcaccgcgttttcttggcggccgagctgcgcctggcgcaccgcgcggagagcctgagccgcctgagcggcggcgtggcgcaggccgagctctacctggcggctcacgggtcgcgcctcaagaagggcccgcgccgcggccgccgcggccgaccccccgcgctgctggcctcggcgctgggcctgggcggctgcgtgccctggggtgccgggcgactgcggcgcggccacggccccgagcccgactcgcccttccgccgcagcccgccccgcggccccgcctccccgcagcgctgacctccacgcccggacccctggccaccccgacaagcttcgccgaggtgccgaccgaccgactgatcgcggacgccggctggaaggactacggatccgcaggaagaggcagttgggggccaggggcccagtagaggaggctgagctccttccaactcctcagaacctccactctatggatctggacctctggattcggctttctccctgggcactgccttcaggaagacgttgagaattgaccttacacaatcccagcgccctcctcacaggagcctttcactttacagtggcaaggggctggttctggagaactggctgatgctctgaatttcttcatataccccacatttgactttggcttacactgtacaattggagatgttgctacaggtccctgagatgcaatcagattaagcgtagcaagcattgccaatgggaaagtcaaaataatttattttttttccctttccccctaccccatccccagccaagaatttcttttcaagatatcgtcatcattcttaaacaacattcttaacccccagctggggtccccattttaatagatgtcattgcttcaagtctaacggcgccgggaggcctgtttgagggaaaacattagtttgaaaaatccccgttcccttcatccactgcccttgttctccacgtgggagtgtgcttgtggcccctcagaaagatagtctgctggctcctaggggttggggtgggggacacacctttttctcaggaagaggtgatggcaatgtaaaacatctaagcaaagttttaaatgaaaaaaaggaaacacatttaaacatcctgataatggagggaaggggggcacatttacacatagcccagaacttgtagaattctgcatagtgaatgtatattgaattagtctcctgccttatacattcaggaggaataaatttccataatgtaaggcaaatgcatggggttctgaggttcactttgcaagtgcccttgctgcctttcctctgtgtctattatggctctttaagttgacggttcctggagcagcttgtatttagtttcgtttggcagtctggccctgttgactttgatttgcagaccaattctcccttgacctgactcacagccgcctgctcttacccccctcctcaggaagtcttcctcattaaaggatgtgatgacgga

SEQ ID NO: 7192 - DNA, 3224 bp, Homo sapiens
gagcattctctctggcagccggggtcacgggcagttgcagccgcggccgagcagccagccgctaagaaagagctcgccgctgccgctcccggagccgccgaggccagcttcgcggcgctgccccgcggcgggagaggaggctgcagaagagcggaggcggccagcgggagcggcggggctcagcgcgcacactcagcggccggggagcctcccgagctctgcgcccgcacgcgccagccgcggctcgcgcctttcttggcctccgggcgcccgacctctcctcccccgcgccggctcgccggggccgcggcggcccaaggagcagcatgaatctgcggctctgcgtgcaggcgctcctgctgctctggctctccttgaccgcggtgtgtggagggtccctgatgccgcttcccgatgggaatgggctggaagacggcaatgtccgccacctggtgcagcccagagggtcaaggaatgggccagggccctggcagggaggtcggaggaaattccgccgccagcggccccgcctctcccataagggacccatgcctttctgaagcaggactgaaggggcccccaagtgcccacccccggcggttatgtctcctccatagattggtctgcttctctggaggcctcacgtccattcagctctcacctcgcacctgctgtagccaccagtgggcccagctcttctcacctgcctgcttcccccagtggcgtgctcctggctgtagtttggatgattcccgttctctcacaagaatccgtccagtccatcttcctggcccctccctggactgactttggagacctagccccagaaagcctcccttcttctccaggtcccctccgccctagtccctgcctgtctcatctaacgccccaaaccttcatttgggccttccttcctcatgtctgccctgagcgcggggtggaagtgctcccttctgtgggctccagcagatcccttgttttcctgtcagttggacccctcacctggcctccagggaagaatgcagagaaaagcaaggagagactctagttaagaggtgctggctgcggggatccagacagggcacattgggggcatggaagtgccagggtggttttcaggagctctggtgaagtgggtggagcatcagcgtttgctcagttaagggagaggtagagaggggcccgtgaagtcctttgtcacttctcttgccttagtgtgcctcccaatactcccttcttcctgcccccacaccccatccccagctagcccaagctccaggtcaggaggggagggtgctgggcctgacatggctatataccctcccaggagtaaaagccaagcaagaggttgtttttgccaagaatcacagaatgttagagctgacaggacccttgaaggtcacttagccttcttaggcaaacgcctgcaaaacagaagcctggagaggggagtgacctgctcagagtcattgcagagccgggatggggaccaggtctcccatctcctactttatgacgccctcttccctcttgatgatgtcttttcaaagcaaatgaagtgccttttcccgaggctggggctgggggtggctgggaggggaagggaagggagaggcaagctggctgtgaactgtcctgttgtggggctggagctgctcccacctccctgacctacccctgctgcaccattcccccagctgggctggaaggttccataactggccagctgcccccataactggcagcattcccagacccagggtactctaataggggcggctcaggcactgagactaccgctcaaccccagggtggttttcaggagtccgaggtagccttcaatcactggactccatggccttcccttcgtgttgaccggaccttccttccagggcttttcctttgggggaggcggagaggggagaagaaggaagggaagggcagaaggaaggagggaagaaaagaaagcaaaggaacagaaggaaggaaagaaagatgggaggaagtgcagcaggaatagcaccctctccccgggaggccctagcttccgtgaggggccatcaccagccattccttggagggggctttctccccttttgcttgagcagggttcccaggagggagaaagagaagacaagagcctgatgcccaactttgtgtgtgtggggacgggggagtcagggccccccaagtcccacaatagccccaatgtttgcctatccacctcccccaagcccctttacctatgctgctgctaacgctgctgctgctgctgctgctgcttaaaggctcatgcttggagtggggactggtcggtgcccagaaagtctcttctgccactgacgcccccatcagggattgggccttctttcccccttcctttctgtgtctcctgcctcatcggcctgccatgacctgcagccaagcccagccccgtggggaaggggagaaagtgggggatggctaagaaagctgggagatagggaacagaagagggtagtgggtgggctaggggggctgccttatttaaagtggttgtttatgattcttatactaatttatacaaagatattaaggccctgttcattaagaaattgttcccttcccctgtgttcaatgtttgtaaagattgttctgtgtaaatatgtctttataataaacagttaaaagctgacagttcgcccttactcttggaggtcatgttcaggaggggcattcctttcccctgggggtcatgggtgtccccatgcccacatattgcacgtgcagggaggtaagtgcctgcatcccaaatcggttctaggtcaactggcctcaaactgatttgccatgagctcacaaaatgaatccctatgcttaatgaccaggtcacataaaatccagcccacttacaggttttctggcatctgtttgggtgtcctaatttttttggcagtgtcatttgaagaatttttttaaagcagtttatttaagaacatactgattaaatgcaggatcgctactaaaaattgttttgtatccttggtgggtgtcttctgctattttatctacttttgaacactttcaggactttttagccagtttgcctttcttgaaaaatgttatgttttcagcaataaatacatttgataatgactttgtttgtatcattttatgtttcacaaagtagagttgcttgatgaatgagatagcctgaaaaataaaatgcaaagagttcaatataa

SEQ ID NO: 7193 - DNA, 3095 bp, Homo sapiens
ggagttgtgctctgcggctgcgaaagtccagcttcggcgactaggtgtgagtaagccagtatcccaggaggagcaagtggcacgtcttcggacctaggctgcccctgccgtcatgtcgcaagggatcctttctccgccagcgggcttgctgtccgatgacgatgtcgtagtttctcccatgtttgagtccacagctgcagatttggggtctgtggtacgcaagaacctgctatcagactgctctgtcgtctctacctccctagaggacaagcagcaggttccatctgaggacagtatggagaaggtgaaagtatacttgagggttaggcccttgttaccttcagagttggaacgacaggaagatcagggttgtgtccgtattgagaatgtggagacccttgttctacaagcacccaaggactcttttgccctgaagagcaatgaacggggaattggccaagccacacacaggttcaccttttcccagatctttgggccagaagtgggacaggcatccttcttcaacctaactgtgaaggagatggtaaaggatgtactcaaagggcagaactggctcatctatacatatggagtcactaactcagggaaaacccacacgattcaaggtaccatcaaggatggagggattctcccccggtccctggcgctgatcttcaatagcctccaaggccaacttcatccaacacctgatctgaagcccttgctctccaatgaggtaatctggctagacagcaagcagatccgacaggaggaaatgaagaagctgtccctgctaaatggaggcctccaagaggaggagctgtccacttccttgaagaggagtgtctacatcgaaagtcggataggtaccagcaccagcttcgacagtggcattgctgggctctcttctatcagtcagtgtaccagcagtagccagctggatgaaacaagtcatcgatgggcacagccagacactgccccactacctgtcccggcaaacattcgcttctccatctggatctcattctttgagatctacaacgaactgctttatgacctattagaaccgcctagccaacagcgcaagaggcagactttgcggctatgcgaggatcaaaatggcaatccctatgtgaaagatctcaactggattcatgtgcaagatgctgaggaggcctggaagctcctaaaagtgggtcgtaagaaccagagctttgccagcacccacctcaaccagaactccagccgcagtcacagcatcttctcaatcaggatcctacaccttcagggggaaggagatatagtccccaagatcagcgagctgtcactctgtgatctggctggctcagagcgctgcaaagatcagaagagtggtgaacggttgaaggaagcaggaaacattaacacctctctacacaccctgggccgctgtattgctgcccttcgtcaaaaccagcagaaccggtcaaagcagaacctggttcccttccgtgacagcaagttgactcgagtgttccaaggtttcttcacaggccgaggccgttcctgcatgattgtcaatgtgaatccctgtgcatctacctatgatgaaactcttcatgtggccaagttctcagccattgctagccagcttgtgcatgccccacctatgcaactgggattcccatccctgcactcgttcatcaaggaacatagtcttcaggtatcccccagcttagagaaaggggctaaggcagacacaggccttgatgatgatattgaaaatgaagctgacatctccatgtatggcaaagaggagctcctacaagttgtggaagccatgaagacactgcttttgaaggaacgacaggaaaagctacagctggagatgcatctccgagatgaaatttgcaatgagatggtagaacagatgcaacagcgggaacagtggtgcagtgaacatttggacacccaaaaggaactattggaggaaatgtatgaagaaaaactaaatatcctcaaggagtcactgacaagtttttaccaagaagagattcaggagcgggatgaaaagattgaagagctagaagctctcttgcaggaagccagacaacagtcagtggcccatcagcaatcagggtctgaattggccctacggcggtcacaaaggttggcagcttctgcctccacccagcagcttcaggaggttaaagctaaattacagcagtgcaaagcagagctaaactctaccactgaagagttgcataagtatcagaaaatgttagaaccaccaccctcagccaagcccttcaccattgatgtggacaagaagttagaagagggccagaagaatataaggctgttgcggacagagcttcagaaacttggtgagtctctccaatcagcagagagagcttgttgccacagcactggggcaggaaaacttcgtcaagccttgaccacttgtgatgacatcttaatcaaacaggaccagactctggctgaactgcagaacaacatggtgctagtgaaactggaccttcggaagaaggcagcatgtattgctgagcagtatcatactgtgttgaaactccaaggccaggtttctgccaaaaagcgccttggtaccaaccaggaaaatcagcaaccaaaccaacaaccaccagggaagaaaccattccttcgaaatttacttccccgaacaccaacctgccaaagctcaacagactgcagcccttatgcccggatcctacgctcacggcgttcccctttactcaaatctgggccttttggcaaaaagtactaaggctgtggggaaagagaagagcagtcatggccctgaggtgggtcagctactctcctgaagaaataggtctcttttatgctttaccatatatcaggaattatatccaggatgcaatactcagacactagcttttttctcacttttgtattataaccacctatgtaatctcatgttgttgtttttttttatttacttatatgatttctatgcacacaaaaacagttatattaaagatattattgttcacattttttattgaattccaaatgtagcaaaatcattaaaacaaattataaaagggacagaaaaa

SEQ ID NO: 7194 - DNA, 893 bp, Homo sapiens
agtctcaatgggggcactggggctggagggcaggggtgggaggctccaggggaggggttccctcctgctagctgtggcaggagccacttctctggtgaccttgttgctggcggtgcctatcactgtcctggctgtgctggccttagtgccccaggatcagggaggactggtaacggagacggccgaccccggggcacaggcccagcaaggactggggtttcagaagctgccagaggaggagccagaaacagatctcagccccgggctcccagctgcccacctcataggcgctccgctgaaggggcaggggctaggctgggagacgacgaaggaacaggcgtttctgacgagcgggacgcagttctcggacgccgaggggctggcgctcccgcaggacggcctctattacctctactgtctcgtcggctaccggggccgggcgccccctggcggcggggacccccagggccgctcggtcacgctgcgcagctctctgtaccgggcggggggcgcctacgggccgggcactcccgagctgctgctcgagggcgccgagacggtgactccagtgctggacccggccaggagacaagggtacgggcctctctggtacacgagcgtggggttcggcggcctggtgcagctccggaggggcgagagggtgtacgtcaacatcagtcaccccgatatggtggacttcgcgagagggaagaccttctttggggccgtgatggtggggtgagggaatatgagtgcgtggtgcgagtgcgtgaatattgggggcccggacgcccaggaccccatggcagtgggaaaaatgtaggagactgtttggaaattgattttgaacctgatgaaaataaagaatggaaagcttcagtgctgccgataaa

SEQ ID NO: 7195 - DNA, 848 bp, Homo sapiens
cagtctcaatgggggcactggggctggagggcaggggtgggaggctccaggggaggggttccctcctgctagctgtggcaggagccacttctctggtgaccttgttgctggcggtgcctatcactgtcctggctgtgctggccttagtgccccaggatcagggaggactgggtttcagaagctgccagaggaggagccagaaacagatctcagccccgggctcccagctgcccacctcataggcgctccgctgaaggggcaggggctaggctgggagacgacgaaggaacaggcgtttctgacgagcgggacgcagttctcggacgccgaggggctggcgctcccgcaggacggcctctattacctctactgtctcgtcggctaccggggccgggcgccccctggcggcggggacccccagggccgctcggtcacgctgcgcagctctctgtaccgggcggggggcgcctacgggccgggcactcccgagctgctgctcgagggcgccgagacggtgactccagtgctggacccggccaggagacaagggtacgggcctctctggtacacgagcgtggggttcggcggcctggtgcagctccggaggggcgagagggtgtacgtcaacatcagtcaccccgatatggtggacttcgcgagagggaagaccttctttggggccgtgatggtggggtgagggaatatgagtgcgtggtgcgagtgcgtgaatattgggggcccggacgcccaggaccccatggcagtgggaaaaatgtaggagactgtttggaaattgattttgaacctgatgaaaataaagaatggaaagcttcagtgctgccgataaa

The invention claimed is:

1. A method of treating fibrosis in a disease characterised by fibrosis, comprising administering a therapeutically-effective amount of an inhibitory nucleic acid comprising or encoding antisense nucleic acid for inhibiting T-cell immunomodulatory protein (ITFG1) gene expression to a subject having the disease characterised by fibrosis, wherein the inhibitory nucleic acid is an siRNA, dsiRNA, shRNA or antisense oligonucleotide.

2. The method according to claim 1, wherein the disease characterised by fibrosis is a disease characterised by fibrosis of the liver.

3. The method according to claim 2, wherein the disease characterised by fibrosis of the liver is selected from: acute liver disease, chronic liver disease, metabolic liver disease, steatosis, liver fibrosis, primary sclerosing cholangitis (PSC), cirrhosis, mild liver fibrosis, advanced liver fibrosis, non-alcoholic fatty liver disease (NAFLD), non-alcoholic steatohepatitis (NASH), alcoholic fatty liver disease (ALFD), alcohol-related liver disease (ARLD), hepatic ischemia reperfusion injury, primary biliary cirrhosis (PBC), hepatitis, liver damage, liver injury, liver failure, metabolic syndrome, obesity, diabetes mellitus, end-stage liver disease, inflammation of the liver, lobular inflammation, and hepatocellular carcinoma (HCC).

4. The method according to claim 3, wherein the disease characterised by fibrosis of the liver is selected from: acute liver disease, chronic liver disease, metabolic liver disease, steatosis, liver fibrosis, primary sclerosing cholangitis (PSC), cirrhosis, non-alcoholic fatty liver disease (NAFLD), non-alcoholic steatohepatitis (NASH), hepatic ischemia reperfusion injury, primary biliary cirrhosis (PBC) hepatitis and liver damage.

5. The method according to claim 1, wherein the inhibitory nucleic acid comprises one or more modified nucleotides selected from: 2'-O-methyluridine-3'-phosphate, 2'-O-methyladenosine-3'-phosphate, 2'-O-methylguanosine-3'-phosphate, 2'-O-methylcytidine-3'-phosphate, 2'-O-methyluridine-3'-phosphorothioate, 2'-O-methyladenosine-3'-phosphorothioate, 2'-O-methylguanosine-3'-phosphorothioate, 2'-O-methylcytidine-3'-phosphorothioate, 2'-fluorouridine-3'-phosphate, 2'-fluoroadenosine-3'-phosphate, 2'-fluoroguanosine-3'-phosphate, 2'-fluorocytidine-3'-phosphate, 2'-fluorocytidine-3'-phosphorothioate, 2'-fluoroguanosine-3'-phosphorothioate, 2'-fluoroadenosine-3'-phosphorothioate, and 2'-fluorouridine-3'-phosphorothioate.

6. The method according to claim 1, wherein the antisense nucleic acid for inhibiting the expression of ITFG1 comprises or consists of a nucleotide sequence having at least 75% sequence identity to any one of SEQ ID NOs: 457 to 1482.

7. The method according to claim 1, wherein the inhibitory nucleic acid comprises a moiety facilitating delivery to and/or uptake by a hepatocyte and/or hepatic tissue.

8. The method according to claim 1, wherein the inhibitory nucleic acid comprises one or more GalNAc moieties.

9. A method of inhibiting fibrosis of the liver in a subject, comprising administering to a subject in need thereof an inhibitory nucleic acid comprising or encoding antisense nucleic acid for inhibiting T-cell immunomodulatory protein (ITFG1) gene expression, wherein the inhibitory nucleic acid is an siRNA, dsiRNA, shRNA or antisense oligonucleotide.

10. The method according to claim 9, wherein the subject has a disease characterised by fibrosis of the liver.

11. The method according to claim 10, wherein the disease characterised by fibrosis of the liver is selected from: acute liver disease, chronic liver disease, metabolic liver disease, steatosis, liver fibrosis, primary sclerosing cholangitis (PSC), cirrhosis, mild liver fibrosis, advanced liver fibrosis, non-alcoholic fatty liver disease (NAFLD), non-alcoholic steatohepatitis (NASH), alcoholic fatty liver disease (ALFD), alcohol-related liver disease (ARLD), hepatic ischemia reperfusion injury, primary biliary cirrhosis (PBC), hepatitis, liver damage, liver injury, liver failure, metabolic syndrome, obesity, diabetes mellitus, end-stage liver disease, inflammation of the liver, lobular inflammation, and hepatocellular carcinoma (HCC).

12. The method according to claim 11, wherein the disease characterised by fibrosis of the liver is selected from: acute liver disease, chronic liver disease, metabolic liver disease, steatosis, liver fibrosis, primary sclerosing cholangitis (PSC), cirrhosis, non-alcoholic fatty liver disease (NAFLD), non-alcoholic steatohepatitis (NASH), hepatic ischemia reperfusion injury, primary biliary cirrhosis (PBC) hepatitis and liver damage.

13. The method according to claim 9, wherein the inhibitory nucleic acid comprises one or more modified nucleotides selected from: 2'-O-methyluridine-3'-phosphate, 2'-O-methyladenosine-3'-phosphate, 2'-O-methylguanosine-3'-phosphate, 2'-O-methylcytidine-3'-phosphate, 2'-O-methyluridine-3'-phosphorothioate, 2'-O-methyladenosine-3'-phosphorothioate, 2'-O-methylguanosine-3'-phosphorothioate, 2'-O-methylcytidine-3'-phosphorothioate, 2'-fluorouridine-3'-phosphate, 2'-fluoroadenosine-3'-phosphate, 2'-fluoroguanosine-3'-phosphate, 2'-fluorocytidine-3'-phosphate, 2'-fluorocytidine-3'-phosphorothioate, 2'-fluoroguanosine-3'-phosphorothioate, 2'-fluoroadenosine-3'-phosphorothioate, and 2'-fluorouridine-3'-phosphorothioate.

14. The method according to claim 9, wherein the antisense nucleic acid for inhibiting the expression of ITFG1 comprises or consists of a nucleotide sequence having at least 75% sequence identity to any one of SEQ ID NOs: 457 to 1482.

15. The method according to claim 9, wherein the inhibitory nucleic acid comprises a moiety facilitating delivery to and/or uptake by a hepatocyte and/or hepatic tissue.

16. The method according to claim 9, wherein the inhibitory nucleic acid comprises one or more GalNAc moieties.

* * * * *